United States Patent
Varenne et al.

(10) Patent No.: US 12,398,183 B2
(45) Date of Patent: Aug. 26, 2025

(54) WHEAT COMPRISING MALE FERTILITY RESTORER ALLELES

(71) Applicants: VILMORIN & CIE, Paris (FR); LIMAGRAIN EUROPE, Saint Beauzire (FR)

(72) Inventors: Pierrick Varenne, Fontainebleau (FR); Jordi Comadran, Riom (FR); Sébastien Specel, Montpensier (FR); Alain Murigneux, La Roche Blanche (FR); Joanna Melonek, Crawley (AU); Ian Small, Wattle Grove (AU); Pascual Perez, Chanonat (FR); Jorge Duarte, Clermont Ferrand (FR); Jean-Philippe Pichon, Clermont Ferrand (FR); Sylvain Levadoux, Clermont Ferrand (FR); Jérôme Martin, Volvic (FR); François Torney, Mahomet, IL (US)

(73) Assignees: VILMORIN & CIE, Paris (FR); LIMAGRAIN EUROPE, Saint Beauzire (FR)

( * ) Notice: Subject to any disclaimer, the term of this patent is extended or adjusted under 35 U.S.C. 154(b) by 293 days.

(21) Appl. No.: 16/760,693

(22) PCT Filed: Oct. 31, 2018

(86) PCT No.: PCT/EP2018/079816
§ 371 (c)(1),
(2) Date: Apr. 30, 2020

(87) PCT Pub. No.: WO2019/086510
PCT Pub. Date: May 9, 2019

(65) Prior Publication Data
US 2020/0347104 A1    Nov. 5, 2020

(30) Foreign Application Priority Data

| Oct. 31, 2017 | (EP) | 17306500 |
| Oct. 31, 2017 | (EP) | 17306501 |
| Jan. 12, 2018 | (EP) | 18305027 |
| Aug. 14, 2018 | (EP) | 18306114 |

(51) Int. Cl.
C12N 15/82    (2006.01)
C07K 14/415   (2006.01)

(52) U.S. Cl.
CPC ........ *C07K 14/415* (2013.01); *C12N 15/8289* (2013.01)

(58) Field of Classification Search
None
See application file for complete search history.

(56) References Cited

U.S. PATENT DOCUMENTS 11,930,756 B2 * 3/2024 Varenne .................... A01H 5/10

FOREIGN PATENT DOCUMENTS

| WO | WO 2017/158128   | * | 9/2017 | ............... A01H 1/04 |
| WO | WO-2017158126 A1 | * | 9/2017 | ............... A01H 1/02 |
| WO | WO-2017158128 A1 | * | 9/2017 | ............. A01H 1/023 |
| WO | 2018/015403 A1   |   | 1/2018 | |

OTHER PUBLICATIONS

Fuji, S. et al., PNAS vol. 108, No. 4 (Jan. 25, 2011) pp. 1723-1728. (Year: 2011).*
Wurschum, T. et al. Genetic architecture of male fertility restoration of Triticum timopheevii cytoplasm and fine-mapping of the major restorer locus Rf3 on chromosome 1B;Theor Appl Genet (2017) 130:1253-1266. (Year: 2017).*
Geyer, M. et al. Molecular Genetics and Genomics (2018) 293:451-462. (Year: 2018).*
Wurschum, T. et al. Theor Appl Genet (2017) 130:1253-1266. (Year: 2017).*
Kazama, T. et al. The Plant Journal (2008) 55, 619-628 (Year: 2008).*
"Protein Rf1, mitochondrial-like (*Aegilops tauschii* subsp. *tauschii*);" Database Protein [Online]; XP-002781672; 2017; Database accession No. XP_020157157.1 sequence.
Geyer et al.; "Distribution of the fertility-restoring gene Rf3 in common and spelt wheat determined by an informative SNP marker;" Mol Breeding; 2016; pp. 1-11 with Electronic supplementary materials; vol. 36, No. 167.
Geyer et al.; "Exploring the genetics of fertility restoration controlled by Rf1 in common wheat (*Triticum aestivum* L.) using high-density linkage maps;" Molecular Genetics and Genomics; 2018; pp. 451-462; vol. 293, No. 2.
Fujii et al.; "Selection patterns on restorer-like genes reveal a conflict between nuclear and mitochondrial genomes throughout angiosperm evolution;" PNAS; 2011; pp. 1723-1728; vol. 108, No. 4.
Lilienfeld; "H. Kihara: Genome-Analysis in Triticum and Aegilops. X. Concluding Review," Cytologia; 1951; pp. 101-123; vol. 16.
Ahmed et al.; "QTL analysis of fertility-restoration against cytoplasmic male sterility in wheat;" Gene Genet. Syst.; 2001; pp. 33-38; vol. 76.
Zhou et al.; "SSR markers associated with fertility restoration genes against Triticum timopheevii cytoplasm in Triticum aestivum;" Euphytica; 2005; pp. 33-40; vol. 141.
Ma et al.; "Cell Biology & Molecular Genetics;" Crop Sci.; 1995; pp. 1137-1143; vol. 35.
Wilson, James A.; "Hybrid Wheat Breeding and Commercial Seed Development;" Plant Breeding Reviews; 1984; pp. 303-319.
Stojalowski et al.; "The importance of chromosomes from the sixth homeologic group in the restoration of male fertility in winter triticale with Triticum timopheevii cytoplasm;" J Appl Genetics; 2013; pp. 179-184; vol. 54.
Würschum et al.; Genetic architecture of male fertility restoration of Triticum timopheevii cytoplasm and fine-mapping of the major restorer locus Rf3 on chromosome 1B; Theor Appl Genet; 2017; pp. 1-23.

(Continued)

*Primary Examiner* — Russell Kallis
(74) *Attorney, Agent, or Firm* — Oliff PLC

(57) ABSTRACT

A wheat transgenic plant carrying restorer of fertility genes specific to *T. timopheevii* CMS cytoplasm.

14 Claims, 28 Drawing Sheets

Figure 2:
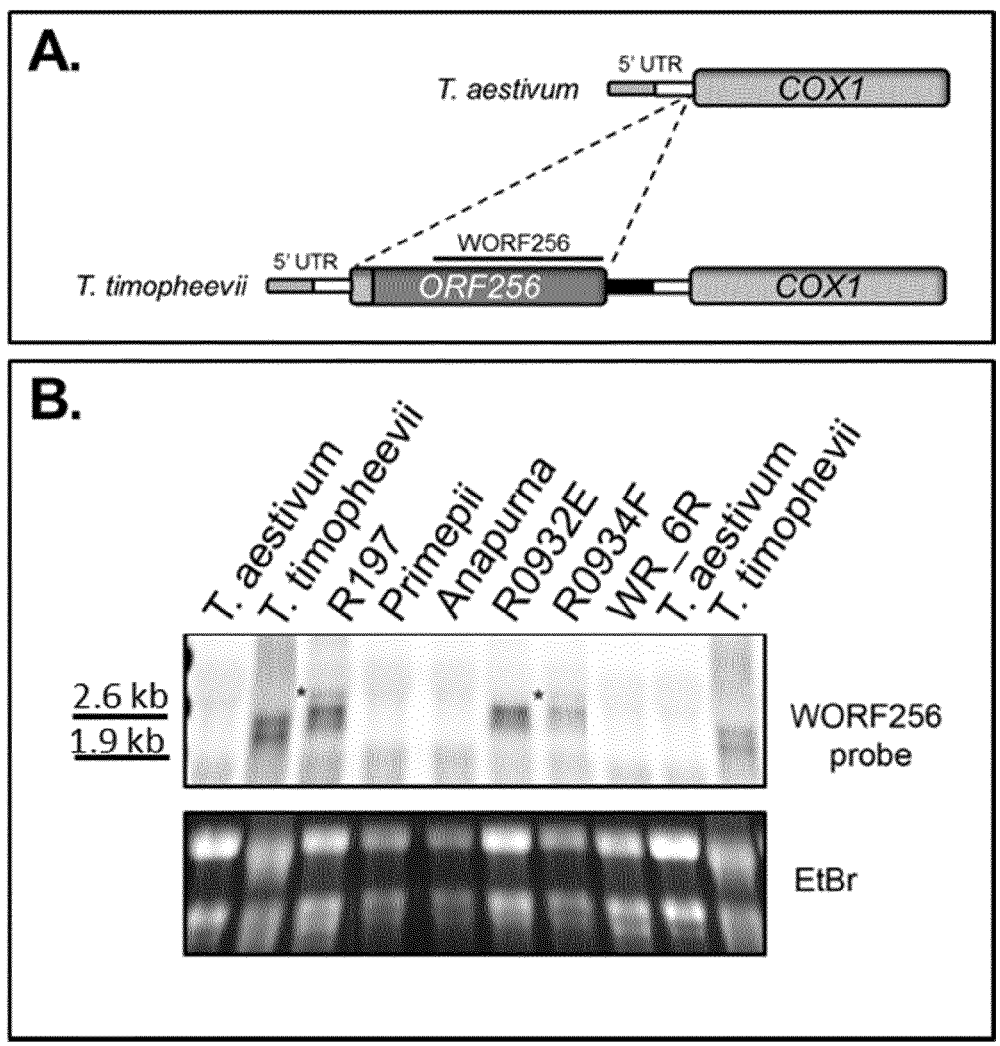

Specification includes a Sequence Listing.

(56) References Cited

OTHER PUBLICATIONS

Brenchley et al.; "Analysis of the bread wheat genome using whole-genome shotgun sequencing;" Nature; 2012; pp. 705-710; vol. 491.

Wickersham et al.; "Male-Fertility Restoration in Crosses of R5 with Soft Red Winter Wheats;" Crop Science; 1980; pp. 100-102; vol. 20; No. 1.

Zhang et al.; "Location of the Fertility Restorer Gene for T-Type CMS Wheat by Microsatellite Marker," Act Genetica Sinica; 2003; pp. 459-464; vol. 30, No. 5.

Bahl et al.; "Chromosomal Location of Male Fertility Restoring Genes in Six Lines of Common Wheat;" Crop Science; 1973; pp. 317-320; vol. 13.

Ling et al.; "Draft genome of the wheat A-genome progenitor Triticum urartu;" Nature; 2013; pp. 87-90; vol. 496.

Dec. 19, 2018 Search Report issued in International Patent Application No. PCT/EP2018/079816.

Ma, Z.-Q et al., "Cell Biology & Molecular Genetics: Genetic Analysis of Fertility Restoration in Wheat Using Restriction Fragment Length Polymorphisms". Crop Science, vol. 35, pp. 1137-1143, 1995.

Wurschum, Tobias et al., "Genetic architecture of male fertility restoration of Triticum timopheevii cytoplasm and fine-mapping of the major restorer locus Rf3 on chromosome 1B". Theoretical and Applied Genetics, vol. 130, pp. 1253-1266, 2017.

Mar. 20, 2023 Office Action issued in U.S. Appl. No. 17/334,472.

\* cited by examiner

| No. | Tribe | Species | Cultivar | Website | References | Number of Identified RFL proteins |
|---|---|---|---|---|---|---|
| 1 | Triticeae | Aegilops tauschii (1) | AL8/78 | http://plants.ensembl.org/Aegilops_tauschii/Info/Index | Jia et al., 2013 | 46 |
| 2 | | Aegilops tauschii (2) | | http://wheat-urgi.versailles.inra.fr/Seq-Repository/Assemblies | Jia et al., 2013 | 31 |
| 3 | | Aegilops speltoides | | http://wheat-urgi.versailles.inra.fr/Seq-Repository/Assemblies | Mayer et al., 2014 | 20 |
| 4 | | Aegilops sharonensis | | http://wheat-urgi.versailles.inra.fr/Seq-Repository/Assemblies | Mayer et al., 2014 | 32 |
| 5 | | Triticum aestivum | | http://plants.ensembl.org/Triticum_aestivum/Info/Index | Mayer et al., 2014 | 98 |
| 6 | | Triticum durum | cv. Cappeli | http://wheat-urgi.versailles.inra.fr/Seq-Repository/Assemblies | Mayer et al., 2014 | 30 |
| 7 | | Triticum durum | cv. Strongfiled | http://wheat-urgi.versailles.inra.fr/Seq-Repository/Assemblies | Mayer et al., 2014 | 30 |
| 8 | | Triticum monococcum | | http://wheat-urgi.versailles.inra.fr/Seq-Repository/Assemblies | Brenchley et al., 2012 | 12 |
| 9 | | Triticum turgidum | | http://www.ncbi.nlm.nih.gov/bioproject/PRJNA191054 | Krasileva et al., 2013 | 25 |
| 10 | | Triticum urartu | | http://archive.gramene.org/Triticum_urartu/Info/Annotation/ | Ling et al., 2013 | 24 |
| 11 | | Hordeum vulgare | Barke | http://pgsb.helmholtz-muenchen.de/plant/barley/index.jsp | Mayer et al., 2013 | 13 |
| 12 | | Hordeum vulgare | Morex | http://pgsb.helmholtz-muenchen.de/plant/barley/index.jsp | Mayer et al., 2013 | 12 |
| 13 | | Hordeum vulgare | Bowman | http://pgsb.helmholtz-muenchen.de/plant/barley/index.jsp | Mayer et al., 2013 | 13 |
| 14 | | Hordeum vulgare | var. distichum | http://plants.ensembl.org/Hordeum_vulgare/Info/Index | Mayer et al., 2012 | 0 |
| 15 | | Lolium perenne | P226/135/1 | http://www.ncbi.nlm.nih.gov/nuccore/GAYX00000000 | Farrel et al., 2014 | 2 |
| 16 | | Secale cereale | | http://pgsb.helmholtz-muenchen.de/plant/rye/index.jsp | Martis et al., 2013 | 0 |
| 17 | Oryzeae | Oryza sativa | | http://phytozome.jgi.doe.gov/pz/portal.html#!bulk?org=Org_Osativa | Ouyang et al., 2007 | 14 |
| 18 | | Oryza sativa japonica | | http://plants.ensembl.org/Oryza_sativa/Info/Index | Kawahara et al., 2013 | 14 |
| 19 | | Oryza indica | Nipponbare | http://plants.ensembl.org/Oryza_indica/Info/Index | Sakai et al., 2013 | 18 |
| 20 | | Oryza sativa Nipponbare | | http://rapdb.dna.affrc.go.jp/index.html | Kawahara et al., 2013 | 14 |
| 21 | | rice cultivar 'Kasalath' | Kasalath | http://rapdb.dna.affrc.go.jp/index.html | Sakai et al., 2013 | 11 |
| 22 | | Oryza barthii | | http://plants.ensembl.org/Oryza_barthii/Info/Index | Jacquemin et al., 2012 | 13 |

Figure 1A.

| # | Tribe | Species | Cultivar | URL | Reference | Count |
|---|---|---|---|---|---|---|
| 23 | | Oryza brachyantha | | http://plants.ensembl.org/Oryza_brachyantha/Info/Index | Chen et al., 2013 | 4 |
| 24 | | Oryza glaberrima | | http://plants.ensembl.org/Oryza_glaberrima/Info/Index | Wang et al., 2014 | 2 |
| 25 | | Oryza glumaepatula | | http://plants.ensembl.org/Oryza_glumaepatula/Info/Index | Jacquemin et al., 2012 | 12 |
| 26 | | Oryza meridionalis | | http://plants.ensembl.org/Oryza_meridionalis/Info/Index | Jacquemin et al., 2012 | 15 |
| 27 | | Oryza nivara | | http://plants.ensembl.org/Oryza_nivara/Info/Index | Jacquemin et al., 2012 | 13 |
| 28 | | Oryza punctata | | http://plants.ensembl.org/Oryza_punctata/Info/Index | Jacquemin et al., 2012 | 7 |
| 29 | | Oryza rufipogon | | http://plants.ensembl.org/Oryza_rufipogon/Info/Index | Jacquemin et al., 2012 | 12 |
| 30 | Brachypodieae | Brachypodium distachyon | | http://phytozome.jgi.doe.gov/pz/portal.html#!bulk?org=Org_Bdistachyon | Brachypodium Initiative | 11 |
| 31 | Eragrostideae | Eragrostis tef | | http://www.tef-research.org/index.html | Cannarozzi et al., 2014 | 33 |
| 32 | Poniceae | Setaria italica | | http://phytozome.jgi.doe.gov/pz/portal.html#!bulk?org=Org_Sitalica | Bennetzen et al., 2012 | 15 |
| 33 | Andropogoneae | Sorghum bicolor | BTx623 | http://plants.ensembl.org/Sorghum_bicolor/Info/Index | Paterson et al., 2006 | 20 |
| 34 | Andropogoneae | Zea mays | B73 | http://plants.ensembl.org/Zea_mays/Info/Index | Schnable et al., 2010 | 6 |
| | | | | | Total | 633 |
| | | | | Reference RFLs | Fujii et al., 2011 | 49 |
| | | | | Sorghum WGS data sets | Mace et al., 2013 | 517 |
| | | | | | Total | 1188 |

Figure 1B

Figure 3

| | origin | T. timopheevi | A. speltoides | T. timopheevi | T. timopheevi | maintainer | maintainer | restorer Rf4- | restorer Rf4- | T. timopheevii |
|---|---|---|---|---|---|---|---|---|---|---|
| | Maintainer | restorer Rf4+ | restorer Rf4+ | restorer Rf4+ | restorer Rf4+ | | | | | |
| RFL group | representative sequence | 17F3R-0377 | GSTR435 | L13 | R113 | ANAPURNA | FIELDER | R0934F | R197 | TRI13159 |
| RFL120 | Triticum-timopheevii.300k_Assembly_Contig_67_1 | 103 | 42 | 101 | 93 | 0 | 0 | 0 | 0 | 157 |
| RFL1211 | Triticum-timopheevii.300k_Assembly_Contig_99_1 | 110 | 0 | 126 | 94 | 0 | 0 | 1 | 0 | 182 |
| RFL123 | Triticum-timopheevii.300k_Assembly_Contig_65_1 | 102 | 0 | 96 | 89 | 0 | 0 | 0 | 0 | 160 |
| RFL204 | Triticum-timopheevii.300k_Assembly_Contig_100_1 | 89 | 0 | 100 | 91 | 0 | 0 | 0 | 0 | 144 |
| RFL130 | Triticum-timopheevii.300k_Assembly_Contig_53_2 | 84 | 0 | 91 | 101 | 0 | 0 | 0 | 0 | 132 |
| RFL207 | Triticum-timopheevii.300k_Assembly_Contig_62_1 | 92 | 0 | 91 | 85 | 1 | 0 | 1 | 0 | 155 |
| RFL135 | Triticum-timopheevii.300k_Assembly_Contig_93_1 | 78 | 0 | 78 | 77 | 0 | 0 | 0 | 0 | 135 |
| RFL162 | Triticum-timopheevii.300k_Assembly_Contig_94_1 | 79 | 0 | 66 | 77 | 0 | 0 | 0 | 0 | 131 |
| RFL340 | Triticum-timopheevii.300k_Assembly_Contig_91_1 | 65 | 6 | 74 | 71 | 1 | 2 | 1 | 1 | 128 |
| RFL160 | Triticum-timopheevii.300k_Assembly_Contig_111_1 | 52 | 0 | 54 | 52 | 0 | 0 | 0 | 0 | 100 |

FIGURE 4a

```
Query    1   AAAAAAGAGAAACGTTTTTATTCAGCAAAGCCACTTCTTGAGAGAGCCGAGGTCTCCCAG    60
             ||||||||||||||||||||||||||||||||||||||||||||||||||||||||||||
Sbjct  391   AAAAAAGAGAAACGTTTTTATTCAGCAAAGCCACTTCTTGAGAGAGCCGAGGTCTCCCAG   450

Query   61   GCCAGTGGCGGCGGCGGAAATACAGAGTGGCGGCG------------------GTCGGG   101
             |||||||||||||||||||| ||||||||||||||                  ||||||
Sbjct  451   GCCAGTGGCGGCGGCGGAAAAACAGAGTGGCGGCGGTCGTCCTCACCGGCGGGCGTCGGG   510

Query  102   GACGCAGCGCGCGGCGACGGAGGGTCGCATTCTCTTCATCGGCGTCAGGGCCGCCGCAGC   161
             |||||||||||||||||||||||||||||||||||||| |||||||||||||||||||||
Sbjct  511   GACGCAGCGCGCGGCGACGGAGGGTCGCATTCTCTTCATCAGCGTCAGGGCCGCCGCAGC   570

Query  162   CAGCGCCGAGCACGGAGATCTCGTCCTCGCCCCCTCAACGCTGCGGCCGTGTCGACCAG   221
             ||||||||||  ||||||||||||||||||||||||||||||||||||||||||||||||
Sbjct  571   CAGCGCCGAGCGCGGAGATCTCGTCCTCGCCCCCTCAACGCTGCGGCCGTGTCGACCAG   630

Query  222   CTCGCCGGCGGTCAGATCTCCTGTACATCGCATTTACCTACTGCAGCAGCTGCAGCTCGA   281
             ||||||||||  ||||||||||||| |||||||||||||||||||||||||||| |||||
Sbjct  631   CTCGCCGGCGGCCAGATCTCCTGTACAGCGCATTTACCTACTGCAGCAGCTGCAACTCGA   690

Query  282   CGGTGAGCATCCTGGCATCCTGACATCTCTTCCATCTTGCTCTGCTTTCCTTCCTTCTAA   341
                |||||||||||||        ||||| ||||||||||||||||||||||||||||||
Sbjct  691   AGGTGAGCATCCTGG---------CATCTCGTCCATCTTGCTCTGCTTTCCTTCCTTCTAA   742

Query  342   CCCCAGGTTCATGCCCAGGCTGCGCCGGTGGTGAGCGGCGGCGGCGCCATCCTATCCCCT   401
             ||||||||||||||||||||||||||||||||||||||||||||||||||||||||||||
Sbjct  743   CCCCAGGTTCATGCCCAGGCTGCGCCGGTGGTGAGCGGCGGCGGCGCCATCCTATCCCCT   802

Query  402   CGAGGGATTCTTCCGGCCAGGTGGAGCTATGAGCCGCCGCTTTGTCCCCGTCGGCAGACG   461
             ||||||||||||||||||||||||||||||||||||||||||||||||||||||||||||
Sbjct  803   CGAGGGATTCTTCCGGCCAGGTGGAGCTATGAGCCGCCGCTTTGTCCCCGTCGGCAGACG   862

Query  462   CATCTTAGAGCAGAACATCAAGGCTCGGTACCACGCCGGAGACATTGGCACCGAGGACGC   521
             ||||||||||||||||||||||||||||||||||||||||||||||||||||||||||||
Sbjct  863   CATCTTAGAGCAGAACATCAAGGCTCGGTACCACGCCGGAGACATTGGCACCGAGGACGC   922

Query  522   ACTCCACCTGTTTGACGAATTGCTCCAGGTTGCTGGGCGCTCCTCGATCCATGCCATCAA   581
             ||||||||||||||||||||||||||||||||||||||||||||||||||||||||||||
```

FIGURE 4a
CONT-1

```
Sbjct   923   ACTCCACCTGTTTGACGAATTGCTCCAGGTTGCTGGGCGCTCCTCGATCCATGCCATCAA   982
Query   582   CTGCCTCCTCACCGTTGTCGGCCGTGATTGCCCTGCGCTCGGCGTCTCCCTCTTCAACCG   641
              |||||||||||||||||||||||||||||||||||||| ||||||||||||||||| ||
Sbjct   983   CTGCCTCCTCACCGTTGTCGGCCGTGATTGCCCTGCGCTTGGCGTCTCCCTCTTCAATCG   1042
Query   642   CGTCGCAAGGGCCAAGGTGGCACCCTGCAGTATCACCTATGCCATTCTGGTCGACTGCTG   701
              ||||||||| ||||||||||||||||||||||||||||||||||||||||||||||||||
Sbjct   1043  CGTCGCAAGGTCCAAGGTGGCACCCTGCAGTATCACCTATGCCATTCTGGTCGACTGCTG   1102
Query   702   CTGCCGCACTGGCCGCCAGGACCTTGGTTTCGCTGCCATGGGACACGTCATCAAGATGGG   761
              ||||||| ||||||||||||||||||||||||||||||||||||||||||||||||||||
Sbjct   1103  CTGCCGCGCTGGCCGCCAGGACCTTGGTTTCGCTGCCATGGGACACGTCATCAAGATGGG   1162
Query   762   ATTTACTGCAGATGCTATGATCACTTTCAGCCACCTACTAAAGGCCATCTGTGCGGAGAA   821
              ||||||||||||||||||||||||||||||||||||||||||||||||||||||||||||
Sbjct   1163  ATTTACTGCAGATGCTATGATCACTTTCAGCCACCTACTAAAGGCCATCTGTGCGGAGAA   1222
Query   822   CAAGACCAGCTATGCAATGGACATCGTACTCCGAATAATGCCCATGTTTAACTGCATACC   881
              ||||||||||||||||||||||||||||||||||||||||||||||| ||||||||||||
Sbjct   1223  CAAGACCAGCTATGCAATGGACATCGTACTCCGAATAATGCCCGTGTTTAACTGCATACC   1282
Query   882   GGATGTCTTCTCTTACAACATTCTTTTCAAGGGTCTCTGCAACGAGAAGAGAAGCCAAGA   941
              |||||||||| |||||||||||||||||||||||||||||||||||||||||||||||||
Sbjct   1283  GGATGTCTTCTCCTACAACATTCTTTTCAAGGGTCTCTGCAACGAGAAGAGAAGCCAAGA   1342
Query   942   GGCTCTCGAGCTGATTCAGGTGATGGTTGAGCATGGAGGTCGCTGCCAACCTGATGTGGT   1001
              |||||||||||||||||||||||||||||||||||||||| |||||||||||||||||||
Sbjct   1343  GGCTCTCGAGCTGATTCAGGTGATGGTTGAGCATGGAGGTGGCTGCCAACCTGATGTGGT   1402
Query   1002  GTCCTATAGCACCGTAATTGATGGCTTGTTGAAAGAGGGTTTGGTGGGCAAGGTTTACAT   1061
              ||| ||||||| ||||||||||||||||||||||||||| |||| ||||| |||||
Sbjct   1403  GTCATATAGCACTGTAATTGATGGCTTGTTGAAAGAGGGTGAGGTGAACAAGGCTTACAG   1462
Query   1062  CCTATTTTGTGAAATGATACAGAGAGGAATT-TCGCCGAATGCTGTGACCTATAACTCAA   1120
              | |||||||||||||| |  | |||       | |||||||| ||||||||| ||  ||||
Sbjct   1463  TCTATTTTGTGAAATGCTGC-GTCAGGGGGTATCGCCGAATGTTGTGACCTGTAGTTCAA   1521
Query   1121  TCATCTCTGGCATGTGCAAGGTTCATGCGATGGACAAGGCTGAGCAGGTTCTTCAACAGA   1180
              |||||||||||||||||||| ||||||||||||||||| |||||| ||||||||||||||
Sbjct   1522  TCATCTCTGGCATGTGCAAGCTTCATGCGATGGACAAAGCTGAGGAGGTTCTTCAACAGA   1581
Query   1181  TGCCTGATAGAGGAATTCTGCCAAATGTTGCCACGTATACTAGTCTAATACATGGATATT   1240
```

FIGURE 4a
CONT-2

```
                   |||  ||||||||||||||||||||||||||||||||||||||||||||||||||||||
Sbjct   1582   TGCTTGATAGAGGAATTCTGCCAAATGTTGCCACGTATACTAGTCTAATACATGGATATT   1641
Query   1241   TTTCATTAGGACAGTGCAAAGAGGTGGATCGGATTTTCAAAGAAATGTCTAGAAATGGTG   1300
               ||||||||||||||||||||||||||| ||||||||||||||||||||||||||||||||
Sbjct   1642   TTTCATTAGGACAGTGCAAAGAGGTTGATCGGATTTTCAAAGAAATGTCTAGAAATGGTG   1701
Query   1301   TTCAACCAAATGTTGTAACTTATAATATACAGATGGATTATCTTTGCAAGAATGGAAGAT   1360
               |||||||||| || ||||||| ||||||||||||||||||||||||||||||||||||||
Sbjct   1702   TTCAACCAAATATTTTAACTTACAATATACAGATGGATTATCTTTGCAAGAATGGAAGAT   1761
Query   1361   GCGCAGAAGCTAGGAAGATTTTTGATTCCATGGTCAGTTTGGGCCAAAAACCGACTGTTA   1420
               ||||||||||||||||||||||||||||||||||||||||||||||||||||||||||||
Sbjct   1762   GCGCAGAAGCTAGGAAGATTTTTGATTCCATGGTCAGTTTGGGCCAAAAACCGACTGTTA   1821
Query   1421   CTACCTACAGCATTTTGCTTCATGGGTATGCTCTGGAACGATCTTTTCATGAGATACATT   1480
               ||||||||||||||||||||||||||||||||||||||||||||||||||||||| ||||
Sbjct   1822   CTACCTACAGCATTTTGCTTCATGGGTATGCTCTGGAACGATCTTTTCATGAGATGCATT   1881
Query   1481   GTCTCATTGATTTGATGGTGGGAAATGGTATTGCGCCAAATCATTTTCTCTACAACATAC   1540
               ||||||||||||||||||||||||||||||||||||||||||||||||||||||||||||
Sbjct   1882   GTCTCATTGATTTGATGGTGGGAAATGGTATTGCGCCAAATCATTTTCTCTACAACATAC   1941
Query   1541   TCATATCTGCATATGCTAAAGAAGAAATGATTGGTGAAGTAATGCATATATTTaaaaaaa   1600
               ||||||||||| |||||||||||||||||||||||||||||||||||||||||||||||
Sbjct   1942   TCATATCTGCATGTGCTAAAGAAGAAATGATTGGTGAAGTAATGCATATATTTAAAAAA    2001
Query   1601   TGCGGCAGCATGGATTGAACCCTAATGTAGCGACCTATGGAGCGGTAGTAAACTTACTTT   1660
               |||||||||||||||||||||||||||||||||| |||||||||||||||||||||||||
Sbjct   2002   TGCGGCAGCATGGATTGAACCCTAATGTAGTGACCTATGGAGCGGTAGTAAACTTACTTT   2061
Query   1661   CCAAGATTGGCCGAATGGATGATGCTATGTCCCAATTCAATCAAATGATAACTGAAGGGT   1720
               ||||||||||||||||||||||||||||||||||||||||||||||||||||||||||||
Sbjct   2062   CCAAGATTGGCCGAATGGATGATGCTATGTCCCAATTCAATCAAATGATAACTGAAGGGT   2121
Query   1721   TAGCTCCTGATATCATAGTTTTCACCCTCCTTATTAGTGGTTTCTGTTCTTGTGGCAAAT   1780
               ||||||||||||||||||||||||||||||||||||||||||||||||||||||||||||
Sbjct   2122   TAGCTCCTGATATCATAGTTTTCACCCTCCTTATTAGTGGTTTCTGTTCTTGTGGCAAAT   2181
Query   1781   GGGAGAAGGTTGATGAACTATTTTCTGAGATGTTGGATCGCGGCATCTGTCCCAACACAG   1840
               |||||||||||||||||||||||||||||||||||||||||||||||||| |||||||||
Sbjct   2182   GGGAGAAGGTTGATGAACTATTTTCTGAGATGTTGGATCGCGGCATCTATCCCAACACAG   2241
```

FIGURE 4a
CONT-3

```
Query  1841  TGTTCTTCAACATAATTATGGACTGCCTCTGCAAAAATGAAAGGGTTATGGAAGCCCAAG  1900
             |||||||||||||  ||||||||||||||  |||||||||||||||||||||||||||||
Sbjct  2242  TGTTCTTCAACACAATTATGGACTGCCTTTGCAAAAATGAAAGGGTTATGGAAGCCCAAG  2301

Query  1901  ATCTCTTCGACCTGATGGTACACATGGGTGTGAAGCCTGATGTGTGTACTTATAACACAC  1960
             |||||||||  |||||||||||||||||||||||||||||||||||||||||||||||||
Sbjct  2302  ATCTCTTCGATCTGATGGTACACATGGGTGTGAAGCCTGATGTGTGTACTTATAACACAC  2361

Query  1961  TGATAGGTGGATACTTGTTCATTGGTAAGATGGATGAAGTGAGGAAGTTACTTGACAATA  2020
             ||||||||||||||||||||||||||||||||||||||||||||||||||||||||||||
Sbjct  2362  TGATAGGTGGATACTTGTTCATTGGTAAGATGGATGAAGTGAGGAAGTTACTTGACAATA  2421

Query  2021  TGGTCTCAATTGGCTTGAAACCAAATGTTATCACATATAGCATACTGATTGATGGTTACT  2080
             ||||||||||||||||||||||||||||||||  ||||||||||||||||||||||||||
Sbjct  2422  TGGTCTCAATTGGCTTGAAACCAAATGTTATTACATATAGCATACTGATTGATGGTTACT  2481

Query  2081  CTAAGAATGGAAGCATAGATGATGCATTGGTTGTTTCCAGGGAAATGTTGGCCGGGAAGG  2140
             ||||||||||  ||||||||||||||||||||||||||||||||||||||||||||||||
Sbjct  2482  CTAAGAATGGAAGGATAGATGATGCATTGGTTGTTTCCAGGGAAATGTTGGCCGGGAAGG  2541

Query  2141  TTAAGCCTTGTGTTATCACTTTTAATATTATGATTGGTGCATTGCTTAAATGTGGCAGGA  2200
             ||||||||||||||||||||||||||||||||||||||||||||||||||||||||||||
Sbjct  2542  TTAAGCCTTGTGTTATCACTTTTAATATTATGATTGGTGCATTGCTTAAATGTGGCAGGA  2601

Query  2201  AGGCAGAAGCCAAAGATTTGTTTGACGGTATCTGGGCCAACGGATTAGTGCCCGATGTTA  2260
             |||||||||||||||||||||||||||||||||||||||||||||||||||||| ||||
Sbjct  2602  AGGCAGAAGCCAAAGATTTGTTTGACGGTATCTGGGCCAACGGATTAGTGCCCGACGTTA  2661

Query  2261  TTACATATAGCTTAATGATACAAAAACTTATTGAAGAAGGTTCTCTACAAGAGTCTGATG  2320
             ||||||||||||||||||||||||||||||  ||||||||||||||||||||||||||||
Sbjct  2662  TTACATATAGCTTAATGATACAAAAACTTGTTGAAGAAGGTTCTCTACAAGAGTCTGATG  2721

Query  2321  ATCTATTCCTTTCTATGGAGAAGAATGGATGTGTTGCCGACTCCCATATGCTAAATGCTA  2380
             ||||||||||||||||||||||||||||||||||||||||||||||||||||||||||||
Sbjct  2722  ATCTATTCCTTTCTATGGAGAAGAATGGATGTGTTGCCGACTCCCATATGCTAAATGCTA  2781

Query  2381  TAGTTAGAAGCTTACTTCAGAAAGGGGAGGTGCCAAGGGCTGGGACTTATCTGTCTAAAA  2440
             ||||||||||||||||||  |||||||||||||||  |||||||||||||||||||||||
Sbjct  2782  TAGTTAGAAGCTTACTTCCGAAAGGGGAGGTGCCCAGGGCTGGGACTTATCTGTCTAAAA  2841

Query  2441  TTGATGAGAGGAGGTTCACCTTTGAAGCTTCCACAGCTAGCTTGTTGGTTGCACTTGCGT  2500
             ||||||||||||  ||||||  ||||||||||||||||||||||||||  |||||||| |
```

FIGURE 4a
CONT-4

```
Sbjct  2842  TTGATGAGAGGAGCTTCACCCTTGAAGCTTCCACAGCTAGCTTGTTGACTGCACTTGCTT  2901
Query  2501  CAGGGCGGAAAAGCCAGGAATATAAGGAGTTACTCCCCGAAAAATACCACTATTTTCTGG  2560
             ||||  ||||| ||||  |||||||||| ||||||||| |||||  |||||||  |||||
Sbjct  2902  CAGGGGGGAAAGGCCAAGAATATAAGGGGTTACTCCCTGAAAACTACCACTCTTTTCTGG  2961
Query  2561  AAGAGGGCACTGATTGAAACCTTTTCTAGAGATTTTGCCTAGATGCTCTGGAGTGCTAAT  2620
             || ||| ||||| |||||||| |||| ||||||||||||||||||||||||||||||||
Sbjct  2962  AATAGGACACTGGTTGAAACCTGTTCTACAGATTTTGCCTAGATGCTCTGGAGTGCTAAT  3021
Query  2621  CGAGGGGTGAACTTCTCTTTGTAGGTTACTTCTTCCAACCTTTTCCTTTTTAGTACGTT  2680
             ||||| ||||||||||||||||||| || ||||||||||||||| |||||||||||||
Sbjct  3022  CGAGGGATGAACTTCTCTTTGTAGGTTATTTCTTCCAACCTTTTCC-TTTTTAGTACGTT  3080
Query  2681  TGAAATGTAATAATCGTTGGAGAAACAGTAGTAAACT     2717
             ||||||||||||||||||||||||||| |||||||||
Sbjct  3081  TGAAATGTAATAATCGTTGGAGAAACTGTAGTAAACT     3117
```

FIGURE 4b

```
RFL120-17F3R-0377_1      ----------------------------------NIKARYHAGDIGTEDALHLFDELLQVAGRSSIHAINCLLTVVGRD
RFL120-L13_1             MSRRFVPVGRRILEQNIKARYHAGDIGTEDALHLFDELLQVAGRSSIHAINCLLTVVGRD
RFL120-R113_1            MSRRFVPVGRRILEQNIKARYHAGDIGTEDALHLFDELLQVAGRSSIHAINCLLTVVGRD
RFL120-timo_1            MSRRFVPVGRRILEQNIKARYHAGDIGTEDALHLFDELLQVAGRSSIHAINCLLTVVGRD
RFL120-GSTR435_1         MSRRFVPVGRRILEQNIKARYHAGDIGTEDALHLFDELLQVAGRSSIHAINCLLTVVGRD
                                                           ***********************************

RFL120-17F3R-0377_1      CPALGVSLFNRVARAKVAPCSITYAILVDCCCCRTGRQDLGFAAMGHVIKMGFTADAMITF
RFL120-L13_1             CPALGVSLFNRVARAKVAPCSITYAILVDCCCCRTGRQDLGFAAMGHVIKMGFTADAMITF
RFL120-R113_1            CPALGVSLFNRVARAKVAPCSITYAILVDCCCCRTGRQDLGFAAMGHVIKMGFTADAMITF
RFL120-timo_1            CPALGVSLFNRVARAKVAPCSITYAILVDCCCCRTGRQDLGFAAMGHVIKMGFTADAMITF
RFL120-GSTR435_1         CPALGVSLFNRVARSKVAPCSITYAILVDCCCCRAGRQDLGFAAMGHVIKMGFTADAMITF
                         **************:******************:.*************************

RFL120-17F3R-0377_1      SHLLKAICAENKTSYAMDIVLRIMPMFNCIPDVFSYNILFKGLCNEKRSQEALELIQVMV
RFL120-L13_1             SHLLKAICAENKTSYAMDIVLRIMPMFNCIPDVFSYNILFKGLCNEKRSQEALELIQVMV
RFL120-R113_1            SHLLKAICAENKTSYAMDIVLRIMPMFNCIPDVFSYNILFKGLCNEKRSQEALELIQVMV
RFL120-timo_1            SHLLKAICAENKTSYAMDIVLRIMPMFNCIPDVFSYNILFKGLCNEKRSQEALELIQVMV
RFL120-GSTR435_1         SHLLKAICAENKTSYAMDIVLRIMPVFNCIPDVFSYNILFKGLCNEKRSQEALELIQVMV
                         *************************:**********************************

RFL120-17F3R-0377_1      EHGGRCQPDVVSYSTVIDGLLKEGLVGKVYILFCEMIQRGISPNAVTYNSIISGMCKVHA
RFL120-L13_1             EHGGRCQPDVVSYSTVIDGLLKEGLVGKVYILFCEMIQRGISPNAVTYNSIISGMCKVHA
RFL120-R113_1            EHGGRCQPDVVSYSTVIDGLLKEGLVGKVYILFCEMIQRGISPNAVTYNSIISGMCKVHA
RFL120-timo_1            EHGGRCQPDVVSYSTVIDGLLKEGLVGKVYILFCEMIQRGISPNAVTYNSIISGMCKVHA
RFL120-GSTR435_1         EHGGGCQPDVVSYSTVIDGLLKEGVNKAYSLFCEMLRQGVSPNVVTCSSIISGMCKLHA
                         ****.******************:. ** :*****::**:.***.**.:***********

RFL120-17F3R-0377_1      MDKAEQVLQQMPDRGILPNVATYTSLIHGYFSLGQCKEVDRIFKEMSRNGVQPNVVTYNI
RFL120-L13_1             MDKAEQVLQQMPDRGILPNVATYTSLIHGYFSLGQCKEVDRIFKEMSRNGVQPNVVTYNI
RFL120-R113_1            MDKAEQVLQQMPDRGILPNVATYTSLIHGYFSLGQCKEVDRIFKEMSRNGVQPNVVTYNI
RFL120-timo_1            MDKAEQVLQQMPDRGILPNVATYTSLIHGYFSLGQCKEVDRIFKEMSRNGVQPNVVTYNI
RFL120-GSTR435_1         MDKAEEVLQQMLDRGILPNVAFYTSLIHGYFSLGQCKEVDRIFKEMSRNGVQPNLLTYNI
                         *****:*****:********:***********************************::****

RFL120-17F3R-0377_1      QMDYLCKNGRCAEARKIFDSMVSLGQKPTVTTYSILLHGYALERSFHEIHCLIDLMVGNG
RFL120-L13_1             QMDYLCKNGRCAEARKIFDSMVSLGQKPTVTTYSILLHGYALERSFHEIHCLIDLMVGNG
RFL120-R113_1            QMDYLCKNGRCAEARKIFDSMVSLGQKPTVTTYSILLHGYALERSFHEIHCLIDLMVGNG
RFL120-timo_1            QMDYLCKNGRCAEARKIFDSMVSLGQKPTVTTYSILLHGYALERSFHEIHCLIDLMVGNG
RFL120-GSTR435_1         QMDYLCKNGRCAEARKIFDSMVSLGQKPTVTTYSILLHGYALERSFHEMHCLIDLMVGNG
                         ************************************************:***********

RFL120-17F3R-0377_1      IAPNHFLYNILIISAYAKEEMIGEVMHIFKKMRQHGLNPNVATYGAVVNLLSKIGRMDDAM
```

FIGURE 4b CONT-1

```
RFL120-17F3R-0377_1      IAPNHFLYNILISAYAKEEMIGEVMHIFKKMRQHGLNPNVATYGAVVNLLSKIGRMDDAM
RFL120-L13_1             IAPNHFLYNILISAYAKEEMIGEVMHIFKKMRQHGLNPNVATYGAVVNLLSKIGRMDDAM
RFL120-R113_1            IAPNHFLYNILISAYAKEEMIGEVMHIFKKMRQHGLNPNVATYGAVVNLLSKIGRMDDAM
RFL120-timo_1            IAPNHFLYNILISAYAKEEMIGEVMHIFKKMRQHGLNPNVATYGAVVNLLSKIGRMDDAM
RFL120-GSTR435_1         IAPNHFLYNILISACAKEEMIGEVMHIFKKMRQHGLNPNVVTYGAVVNLLSKIGRMDDAM
                         ************** ************************.*****************

RFL120-17F3R-0377_1      SQFNQMITEGLAPDIIVFTLLISGFCSCGKWEKVDELFSEMLDRGICPNTVFFNIIMDCL
RFL120-L13_1             SQFNQMITEGLAPDIIVFTLLISGFCSCGKWEKVDELFSEMLDRGICPNTVFFNIIMDCL
RFL120-R113_1            SQFNQMITEGLAPDIIVFTLLISGFCSCGKWEKVDELFSEMLDRGICPNTVFFNIIMDCL
RFL120-timo_1            SQFNQMITEGLAPDIIVFTLLISGFCSCGKWEKVDELFSEMLDRGICPNTVFFNIIMDCL
RFL120-GSTR435_1         SQFNQMITEGLAPDIIVFTLLISGFCSCGKWEKVDELFSEMLDRGIYPNTVFFNIIMDCL
                         ********************************************* *************

RFL120-17F3R-0377_1      CKNERVMEAQDLFDLMVHMGVKPDVCTYNTLIGGYLFIGKMDEVRKLLDNMVSIGLKPNV
RFL120-L13_1             CKNERVMEAQDLFDLMVHMGVKPDVCTYNTLIGGYLFIGKMDEVRKLLDNMVSIGLKPNV
RFL120-R113_1            CKNERVMEAQDLFDLMVHMGVKPDVCTYNTLIGGYLFIGKMDEVRKLLDNMVSIGLKPNV
RFL120-timo_1            CKNERVMEAQDLFDLMVHMGVKPDVCTYNTLIGGYLFIGKMDEVRKLLDNMVSIGLKPNV
RFL120-GSTR435_1         CKNERVMEAQDLFDLMVHMGVKPDVCTYNTLIGGYLFIGKMDEVRKLLDNMVSIGLKPNV
                         ************************************************************

RFL120-17F3R-0377_1      ITYSILIDGYSKNGSIDDALVVSREMLAGKVKPCVITFNIMIGALLKCGRKAEAKDLFDG
RFL120-L13_1             ITYSILIDGYSKNGSIDDALVVSREMLAGKVKPCVITFNIMIGALLKCGRKAEAKDLFDG
RFL120-R113_1            ITYSILIDGYSKNGSIDDALVVSREMLAGKVKPCVITFNIMIGALLKCGRKAEAKDLFDG
RFL120-timo_1            ITYSILIDGYSKNGSIDDALVVSREMLAGKVKPCVITFNIMIGALLKCGRKAEAKDLFDG
RFL120-GSTR435_1         ITYSILIDGYSKNGRIDDALVVSREMLAGKVKPCVITFNIMIGALLKCGRKAEAKDLFDG
                         ************** *********************************************

RFL120-17F3R-0377_1      IWANGLVPDVITYSLMIQKLIEEGSLQESDDLFLSMEKNGCVADSHMLNAIVRSLLQKGE
RFL120-L13_1             IWANGLVPDVITYSLMIQKLIEEGSLQESDDLFLSMEKNGCVADSHMLNAIVRSLLQKGE
RFL120-R113_1            IWANGLVPDVITYSLMIQKLIEEGSLQESDDLFLSMEKNGCVADSHMLNAIVRSLLQKGE
RFL120-timo_1            IWANGLVPDVITYSLMIQKLIEEGSLQESDDLFLSMEKNGCVADSHMLNAIVRSLLQKGE
RFL120-GSTR435_1         IWANGLVPDVITYSLMIQKLVEEGSLQESDDLFLSMEKNGCVADSHMLNAIVRSLLRKGE
                         ******************** ***********************************:***

RFL120-17F3R-0377_1      VPRAGTYLSKIDERRFTFEASTASLLVALASGRKSQEYKELLPEKYHYFLEEGTD
RFL120-L13_1             VPRAGTYLSKIDERRFTFEASTASLLVALASGRKSQEYKELLPEKYHYFLEEGTD
RFL120-R113_1            VPRAGTYLSKIDERRFTFEASTASLLVALASGRKSQEYKELLPEKYHYFLEEGTD
RFL120-timo_1            VPRAGTYLSKIDERRFTFEASTASLLVALASGRKSQEYKELLPEKYHYFLEEGTD
RFL120-GSTR435_1         VPRAGTYLSKIDERSFTLEASTASLLTALASGGKGQEYKGLLPENYHSFLE------
                         ************** **.******** ***** *.**** ***:**.***
```

FIGURE 5A

```
RFL29a     MPRFSSTTPMSPPRLR--LRLCARHSSSTSHPSRIWDPHAAFAAAAQRASSGTLTTEDAH
RFL29b     MPRFSSTTPMSPPRLRLRLRLCARHSSSTSHPSRIWDPHAAFAAAAQRASSGTLTTEDAH
RFL29c_1   MPRFSSTTPMSPPRLR--LRLCARHSSCTSHPSRIWDPHAAFAAAAQRASSGTLTTEDAH
RFL29c_2   ------------------------------------------------------------

RFL29a     HLFDELLRRGNPVQERPLNKFLAALARAPASASCCDGPALAVALFGRLSRDVGRRVAQPN
RFL29b     HLFDELLRRGNPVQERPLNKFLAALARAPASASCCDGPALAVTLFGRLSRDVGRRVAQPN
RFL29c_1   HLFDELLRRGNPVQERPLNKFLAALARAPASASCCDGPALAVALFGRLSQDVRRRVAQPN
RFL29c_2   ------------------------------------------------------------

RFL29a     VFTYGVLMDCCCRACRTDLVLAFFGRLLKTGLEANQVVFNTLLKGLCHTKRADEALDVLL
RFL29b     VFTYGVLMDCCCRACRTDLVLAFFGRLLKTGLEANQVVFNTLLKGLCHTKRADEALDVLL
RFL29c_1   VFTYGVLMDCCCRACRTDLALAFFGRLLKTGLEANQVVFNTLLKGLCHTKRADEALDVLL
RFL29c_2   ------------------------------------------------------------

RFL29a     HRMPELGCTPNVVAYNTVIHGFFKEGHVSKACNLFHEMAQQGVKPNVVTYNSVIDALCKA
RFL29b     HRMPELGCTPNVVAYNTVIHGFFKEGHVSKACNLFHEMAQQGVKPNVVTYNSVIDALCKA
RFL29c_1   HRMPELGCTPDVVAYNTVIHGFFKEGHVSKACNLFHEMAQQGVKPNVVTYNSVIDALCKA
RFL29c_2   ------------------------------------------------------------

RFL29a     RAMDKAEVVLRQMIDDGVGPDNVTYSSLIHGYSSSGHWKEAVRVFKEMTSRRVTADVHTY
RFL29b     RAMDKAEVVLRQMIDDGVGPDNVTYSSLIHGYSSSGHWKEAVRVFKEMTSRRVTADVHTY
RFL29c_1   RAMDKAEVVLRQMIDDGVGP----------------------------------------
RFL29c_2   --------------MMVLDLNVTYSSLIHGYSSSGHWKEAVRVFKEMTSRRVTADVHTY

RFL29a     NMFMTFLCKHGRSKEAAGIFDTMAIKGLKPDNVSYAILLHGYAAEGCLVDMINLFNSMER
RFL29b     NMFMTFLCKHGRSKEAAGIFDTMAIKGLKPDNVSYAIRLHGYATEGCLVDMINLFNSMAT
RFL29c_1   ------------------------------------------------------------
RFL29c_2   NMFMTFLCKHGRSKEAAGIFDTMAIKGLKPDNVSYAILLHGYAAEGCLVDMINLFNSMER

RFL29a     DCILPDCRIFNILINAYAKSGKLDKAMLIFNEMQKQGVSPNAVTYSTVIHAFCKKGRLDD
RFL29b     HCILPNCHIFNILINAYAKSGKLDKAMLIFNEMQKQGVSPNAVTYSTVIHAFCKKGRLDD
RFL29c_1   ------------------------------------------------------------
RFL29c_2   DCILPDCRIFNILINAYAKSGKLDKAMLIFNEMQKQGVSPNAVTYSTVIHAFCKKGRLDD

RFL29a     AVIKFNQMIDTGVRPDASVYRPLIQGFCTHGDLVKAKEYVTEMWKKGMPPPDIMFFSSIM
RFL29b     AVIKFNQMIDTGVRPDASVYRPLIQGFCTHGDLVKAKEYVTEMWKKGMPPPDIMFFSSIM
RFL29c_1   ------------------------------------------------------------
RFL29c_2   AVIKFNQMIDTGVRPDASVYRPLIQGFCTHGDLVKAKEYVTEMWKKGMPPPDIMFFSSIM
```

FIGURE 5A
CONT-1

```
RFL29a    QNLCTEGRVTEARDILDLIVHIGMRPNVIIFNLLIGGYCLVRKMADALKVFDDMVSYGLE
RFL29b    QNLCTEGRVTEARDILDLIVHIGMRPNVIIFNLLIGGYCLVRKMADALKVFDDMVSYGLE
RFL29c_1  ------------------------------------------------------------
RFL29c_2  QNLCTEGRVTEARDILDLIVHIGMRPNVIIFNLLIGGYCLVRKMADALKVFDDMVSYGLE

RFL29a    PCNFTYGILINGYCKNRRIDDGLILFKEMLHKGLKPTTFNYNVILDGLFLAGQTVAAKEK
RFL29b    PCNFTYGILINGYCKNRRIDDGLILFKEMLHKGLKPTTFNYNVILDGLFLAGQTVAAKEK
RFL29c_1  ------------------------------------------------------------
RFL29c_2  PCNFTYGILINGYCKNRRIDDGLILFKEMLHKGLKPTTFNYNVILDGLFLAGQTVAAKEK

RFL29a    FDEMVESGVSVCIDTYSIILGGLCRNSCSSEAITLFRKLSAMNVKFDITIVNIIGALYR
RFL29b    FDEMVESGVSVCIDTYSIILGGLCRNSCSSEAITLFRKLSAMNVKFDITIVNIIGALYR
RFL29c_1  ------------------------------------------------------------
RFL29c_2  FDEMVESGVSVCIDTYSIILGGLCRNSCSSEAITLFRKLSAMNVKFDITIVNIIGALYR

RFL29a    VERNQEAKDLFAAMPANGLVPNAVTYTVMMTNLIKEGSVEEADNLFLSMEKSGCTANSCL
RFL29b    VERNQEAKDLFAAMPANGLVPNAVTYTVMMTNLIKEGSVEEADNLFLSMEKSGCTANSCL
RFL29c_1  ------------------------------------------------------------
RFL29c_2  VERNQEAKDLFAAMPANGLVPNAVTYTVMMTNLIKEGSVEEADNLFLSMEKSGCTANSCL

RFL29a    LNHIIRRLLEKGEIVKAGNYMSKVDAKSYSLEAKTVSLLISLFSRKGKYREHIKLLPTKY
RFL29b    LNHIIRRLLEKGEIVKAGNYMSKVDAKSYSLEAKTVSLLISLFSRKGKYREHIKLLPTKY
RFL29c_1  ------------------------------------------------------------
RFL29c_2  LNHIIRRLLEKGEIVKAGNYMSKVDAKSYSLEAKTVSLLISLFSRKGKYREHIKLLPTKY

RFL29a    QFLEEAATVE
RFL29b    QFLEEAATVE
RFL29c_1  ----------
RFL29c_2  QFLEEAATVE
```

FIGURE 5B

```
RFL164a    MPGFSSAASMSPLRLRLRLHARHSS-ASQPSRRQGWDPHAAFAAATECARSGNLTPEDAH
RFL164b    MPGFSSAASMSPLRLRLRLHARHSSSASQPSRRQGWDPHAAFAAATECARSGNLTPEDAH

RFL164a    NLFDELLRQGNPVLGRPLNNLLAALARAPASSACRDGPALVVALFSRISQGARLRVLHPT
RFL164b    HLFDELLRQGNPVLGRPLNNLLAALARAPASSACRDGPALAVALFSRISQGARLRVLHPT

RFL164a    ACTYGILMDCSCRAHRLDLAFAFFGRLLRTGLKAGVIEVNSLLKGLCHAKRADEAMEVLL
RFL164b    ACTYGILMDCSCRAHRLNLAFAFFGRLLRTGLKAGVIEVNSLLKGLCHAKRADEAMEVLL

RFL164a    HRMPELFIGVQGTAVYRSLIQGFCTHGDLVKAKEYVTEMMKKGMPPPDIMFFSSIMQNLC
RFL164b    HRMPELFIGVQGTAVYRSLIQGFCTHGDLVKAKEYVTEMMKKGMPPPDIMFFSSIMQNLC

RFL164a    TEGRVIEARDILDLIVRIGMRPDVFIFNILIGGYCLVGKMEDASKIFDDMVSYGLEPCNF
RFL164b    TEGRVIEARDILDLIVRIGMRPDVFIFNILIGGYCLVGKMEDASKIFDDMVSYGLEPCNF

RFL164a    TYGILINGYCKNKRIDDGLILFKEMLRKGLKPTTFNYNVILDGLFLAGQTVAAKEKFDEM
RFL164b    TYGILINGYCKNKRIDDGLILFKEMLRKGLKPTTFNYNVILDGLFLAGQTVAAKEKFDEM

RFL164a    VESGVSVCIDTYSIVLGGLCRNSCSSEAITLF----------------------------
RFL164b    VESGVSVCIDTYSIVLGGLCRNSCSSEAITLFRKLSAMNVKFNITIVNTIIGAFYRVERN

RFL164a    ------------------------------------------------------------
RFL164b    QEAKDLFAAIPASGLVPNVVTYTIMIKNLIKEGSVEEADNLFLSMEKSGCSANSYLLNHI

RFL164a    ------------------------------------------------------------
RFL164b    IRRLLEKGEIVKAGNYMSKVDAKSYSLEAKTVSLLISLFSRKGKYREHIKLLPTKYQFLE

RFL164a    ------
RFL164b    EAATVE
```

FIGURE 5C

```
RFL166a    MPRLSSTTPMSPPRLRLRLRGRHSSSTSHPSRIWDPHAAFAGATQRAHSGNLTPEDAHHL
RFL166b    ------------------------------------------------------------

RFL166a    FDELLRQGNPVQERPLTNFLAALARAPASASCSDGPALAVALFGRLSRGAGRRVAQPNVF
RFL166b    ------------------------------------------------------------

RFL166a    TYGVLMDCCCRACRPDLALAFFGRLFRKGLEANRVIFCTLLKGLCHAKRTDEALDVLLHR
RFL166b    ------------------------------------------------------------

RFL166a    MPELGCTPNVVAYTTVIHGFFKEGQVGKACNLFHGMAQQGVAPNLVTYNSVIDALCKAKA
RFL166b    MPELGCTPNVVAYTTVIHGFFKEGQVGKACNLFHGMAQQGVAPNLVTYNSVIDALCKAKA

RFL166a    MDKAEYFLGQMVDDGVVPDNVTYNSLIHGYSSSGHWKEAVRVFKEMTSRRVTADVHTYNM
RFL166b    MDKAEYFLGQMVDDGVVPDNVTYNSLIHGYSSSGHWKEAVRVFKEMTSRRVTADVHTYNM

RFL166a    FMTFLCKHGRSKEAAGIFDTMAIKGLKPDNVSYAILLHGYATEGCLVDMINLFNSMERDC
RFL166b    FMTFLCKHGRSKEAAGIFDTMAMKGLKPDNVSYAILLHGYATEGCLVDMINLFNSMERDC

RFL166a    ILPDCRIFNILINAYAKSGKLDKAMLIFNEMQKQGVSPNAVTYSTVIHTFCKKGRLDDAV
RFL166b    ILPDCRIFNILINAYAKSGKLDKAMLIFNEMQKQGVSPNAVTYSTVIDAFCKKGQLDDAM

RFL166a    IKFNQMIDTGVRQGTAVYGSLIQGFCTHGDLVKAKELLTEMMNKGMLPPDIKFFHSIMQN
RFL166b    IKFNQMIDTGVRQGTAVYGSLIQGFCTHGDLVKAKELLTEMMNKGMLPPDIKFFHSIMQN

RFL166a    LCTEGRVIEARDVLGLIAHIGMRPDVCTFNILIGGYCLVGKMEDASKIFDDMMSYGLEPS
RFL166b    LCTEGRVIEARDVLGLIAHIGMRPDVCTFNILIGGYCLVGKMEDASKIFDDMMSYGLEPS

RFL166a    NC----------------------------------------------------------
RFL166b    NITYGILINGYCKNRRIDDGLILFKEMLHKGLKPTTFNYNIILDGLLLAGRTVAAKEKFN
```

FIGURE 6

```
RFL29a_5UTR    CTCCGTCCGAAAATACTTGTCGAAGAATTTGATGAAAATGGATGCATCTAGAACAAGAAT
RFL29b_5UTR    CTCCGTCCGGAAATACTTGTCGAAGAATTTGATGAAAATGGATGCATCTAGAACAAGAAT

RFL29a_5UTR    ACATCTAGATACATCAATCTCCCCGACAAGTATTTCCGAACGGAGGGAGTACTAGATAAT
RFL29b_5UTR    ACATCTAGATACATCAATCTCCCTGACAAGTATTTCCGAGCGGAGGGAGTACTAGATAAT

RFL29a_5UTR    A-----------------------------------------------------------
RFL29b_5UTR    ACTCCCTCCGTTCCTAAATAATTGTCTTTCTAGCTATCTCAAATAAACTACAACATACGG

RFL29a_5UTR    ------------------------------------------------------------
RFL29b_5UTR    ATGTATGTAGACATGTTTTAGAGTGTAGATTCACTCATTTTGTTCCGTATGTAGTCATTT

RFL29a_5UTR    ---------------------------------------------AGATAACTATCCAAAA
RFL29b_5UTR    GTTGAAATCTCTAGAGAGACAATTATTTAGGAACGGAGGGAGTAAGATAACTACCC-TAA

RFL29a_5UTR    AAAAAAAGATAACTGAAGGTTGCCACCTAGCACATTCACATTGGTACAACTTGGAAAAGC
RFL29b_5UTR    AAAAAAAGATAACTGAAGGTTGCCACCTAGCACATTCACATTGGTACAACTTGGAAAAGC

RFL29a_5UTR    ACAGCCCCGTCGTCCTGCTCCCAGTTGAGTTCGCGACCTACACACCGGCC
RFL29b_5UTR    ACAGCCCCGTCGTCCTGCTCCCAGTTGAGTTCGCGACCTACACACCGGCC
```

| Marker id. | position relative to fine-mapping interval | Physical position |
|---|---|---|
| cfn0523072 | Left | 13857528 |
| cfn0523109 | Left | 14161545 |
| 276113_96B22_9_7797 | Left | 14184332 |
| Cfn0522096 | Interval | 14505168 |
| cfn0527763 | Interval | 14550727 |
| 104A4_105172 | Interval | 14603881 |
| 104A4_105588 | Interval | 14604601 |
| cfn0373248 | Interval | 14620761 |
| cfn1097828 | Interval | 15052112 |
| Cfn0527067 | Interval | 15346090 |
| cfn0528390 | right | 16373906 |
| BWS0267 | right | 16389969 |
| cfn0527718 | right | 16409826 |
| cfn0524469 | right | 17257737 |
| cfn0524921 | right | 18291418 |
| cfn1122326 | right | 20205981 |

FIGURE 10A

| CODE | R: restorer/ M: maintenor | Rf alleles | cfn0523072 | cfn0523109 | 97797 | cfn0527763 | 10A4_105172 | 10A4_105588 | cfn0373248 | cfn1097828 | cfn0528390 | BWS0267 | cfn0527718 | cfn0524469 | cfn0524921 | cfn1122326 |
|---|---|---|---|---|---|---|---|---|---|---|---|---|---|---|---|---|
| R197 | R | homozygous Rf1, rf3, Rf7 | T | A | C | C | TG | A | T | C | G | A | T | G | G | C |
| R204 | R | homozygous Rf1, rf3, Rf7 | T | A | C | C | TG | A | T | C | G | A | T | G | G | C |
| R0932E | R | homozygous Rf1, rf3, Rf7 | T | A | C | C | TG | A | T | C | G | A | T | G | G | C |
| LGWR16-0016 | R | homozygous Rf1, rf3, Rf7 | C | A | C | C | TG | A | T | C | G | A | C | G | G | C |
| LGWR16-0026 | R | homozygous Rf1, rf3, Rf7 | C | A | C | C | TG | A | T | C | G | A | C | G | G | C |
| AIGLE | M | homozygous rf1, rf3, rf7 | T | C | T | C | - | C | T | C | A | G | T | - | A | T |
| AIRBUS | M | homozygous rf1, rf3, rf7 | T | A | T | C | CA | C | T | C | G | G | T | - | A | T |
| ALHAMBRA | M | homozygous rf1, rf3, rf7 | T | C | T | C | - | C | T | C | A | G | T | T | A | T |

FIGURE 10B

| CODE | R: restorer/ M: maintenor | Rf alleles | cfn0523072 | cfn0523109 | 97797 | cfn0527763 | 104A4_105172 | 104A4_105588 | cfn0373248 | cfn1097828 | cfn0528390 | BWS0267 | cfn0527718 | cfn0524469 | cfn0524921 | cfn1122326 |
|---|---|---|---|---|---|---|---|---|---|---|---|---|---|---|---|---|
| ALIXAN | M | homozygous rf1, rf3, rf7 | T | - | T | T | CA | C | T | T | A | G | T | - | A | T |
| AMADEUS | M | homozygous rf1, rf3, rf7 | T | A | T | T | CA | C | T | T | G | A | T | - | A | T |
| ANAPURNA | M | homozygous rf1, rf3, rf7 | T | C | T | C | - | C | T | C | A | H | T | - | A | T |
| APACHE | M | homozygous rf1, rf3, rf7 | T | A | T | T | CA | C | T | T | G | G | T | - | A | T |
| ARKEOS | M | homozygous rf1, rf3, rf7 | T | C | T | T | CA | C | T | T | A | G | T | - | A | T |
| ARLEQUIN | M | homozygous rf1, rf3, rf7 | T | A | T | T | CA | C | T | T | G | G | T | - | A | T |
| ARTDECO | M | homozygous rf1, rf3, rf7 | T | C | T | C | - | C | T | C | A | G | T | T | H | T |
| ARTURNICK | M | homozygous rf1, rf3, rf7 | T | C | T | T | CA | C | T | T | H | G | T | G | A | T |

FIGURE 10C

| CODE | R: restorer/ M: maintenor | Rf alleles | cfn0523072 | cfn0523109 | 97797 | cfn0527763 | 104A4_105172 | 104A4_105588 | cfn0373248 | cfn1097828 | cfn0528390 | BWS0267 | cfn0527718 | cfn0524469 | cfn0524921 | cfn1122326 |
|---|---|---|---|---|---|---|---|---|---|---|---|---|---|---|---|---|
| ATOMO | M | homozygous rf1, rf3, rf7 | T | C | T | T | CA | C | T | C | G | A | T | G | A | T |
| AVENUE | M | homozygous rf1, rf3, rf7 | T | C | T | C | - | C | T | C | A | G | T | - | A | T |
| CEZANNE | M | homozygous rf1, rf3, rf7 | T | A | T | T | CA | C | T | T | G | A | T | - | A | T |
| CROISADE | M | homozygous rf1, rf3, rf7 | C | A | T | - | - | C | A | - | G | A | C | G | G | C |
| FRUCTIDOR | M | homozygous rf1, rf3, rf7 | T | A | T | T | CA | C | T | T | G | G | T | - | A | T |
| GAZUL | M | homozygous rf1, rf3, rf7 | T | A | T | T | CA | C | T | T | A | G | T | T | A | T |
| HERMANN | M | homozygous rf1, rf3, rf7 | T | C | T | C | CA | C | T | C | G | H | C | - | H | T |
| HORATIO | M | homozygous rf1, rf3, rf7 | C | C | T | C | - | C | T | C | A | G | T | T | A | C |
| KALAHARI | M | homozygous rf1, rf3, rf7 | T | C | T | C | - | C | T | C | A | G | T | T | A | T |

FIGURE 10D

| Marker names | position relative to fine-mapping interval | Physical position |
|---|---|---|
| cfn1252000 | Left | 1670498 |
| IWB14060* | Left | 1762323 |
| Cfn1249269 | Interval | 1778039 |
| 219K1_166464 | Interval | 1789599 |
| 219K1_158251 | Interval | 1789721 |
| 219K1_111446 | Interval | 1796283 |
| 219K1_110042 | Interval | 1796422 |
| 219K1_110005 | Interval | 1796428 |
| 219K1_107461 | Interval | 1796680 |
| 219K1_99688 | Interval | 1797457 |
| 219K1_37 | Interval | 1807903 |
| cfn1270524 | Interval | 1816050 |
| 136H5_3M5_7601 | Interval | 1823908 |
| cfn1288811 | Interval | 1825046 |
| 136H5_3M5_89176 | Interval | 1825372 |
| 136H5_3M5_89263 | Interval | 1825378 |
| 136H5_3M5_138211 | Interval | 1826466 |
| cfn0556874 | Interval | 1842122 |
| 136H5_3M5_64154 | Interval | 1903965 |
| 136H5_3M5_68807 | Interval | 1904430 |
| 136H5_3M5_77916 | Interval | 1905289 |
| cfn1246088 | Interval | 1984106 |
| cfn1287194 | Interval | 1991502 |
| cfn1258380 | Interval | 2012753 |
| IWB72107* | Interval | 2058798 |
| BS00090770 | Interval | 2058919 |
| cfn1239345 | Right | 3087865 |

FIGURE 11A

FIGURE 11B

| CODE | # | R: restorer/M: maintainer | Rf alleles | cfn1252000 | IWB14060* | cfn1249269 | 219K1_166464 | 219K1_158251 | 219K1_111446 | 219K1_110042 | 219K1_110005 | 219K1_107461 | 219K1_99688 | 219K1_37 | cfn1270524 | 136H5_3M5_7601 | cfn1288811 | 136H5_3M5_89176 | 136H5_3M5_89263 | 136H5_3M5_138211 | cfn0556874 | 136H5_3M5_64154 | 136H5_3M5_68807 | 136H5_3M5_77916 | cfn1246088 | cfn1287194 | cfn1258380 | IWB72107* | BS00090770 | cfn1239345 |
|---|---|---|---|---|---|---|---|---|---|---|---|---|---|---|---|---|---|---|---|---|---|---|---|---|---|---|---|---|---|---|
| TJB155 | 1 | R | homozygous Rf1, Rf3, Rf7 | A | G | G | T | G | A | T | C | A | T | C | T | T | G | A | T | T | C | C | G | A | A | G | A | A | T | A |
| LGWR16-0016 | 2 | R | homozygous Rf1, Rf3, Rf7 | A | G | G | T | G | A | T | C | A | T | C | T | T | G | A | T | T | C | C | G | A | A | G | A | A | T | A |
| LGWR16-0026 | 3 | R | homozygous Rf1, Rf3, Rf7 | A | G | G | T | G | A | T | C | A | T | C | T | T | G | A | T | T | C | C | G | A | A | G | A | A | T | A |
| AIGLE | 4 | M | homozygous rf1, rf3, rf7 | G | A | A | C | G | - | T | C | A | - | - | C | - | G | C | A | T | C | - | - | C | T | - | G | C | A |
| AIRBUS | 5 | M | homozygous rf1, rf3, rf7 | G | G | G | C | G | - | T | C | A | - | - | C | - | G | C | A | C | T | A | G | C | A | C | G | C | A |
| ALHAMBRA | 6 | M | homozygous rf1, rf3, rf7 | A | A | A | C | G | - | T | - | A | - | C | C | - | G | C | A | T | C | - | - | C | T | - | G | C | A |
| ALIXAN | 7 | M | homozygous rf1, rf3, rf7 | G | G | G | C | G | - | T | - | A | T | - | C | - | G | C | A | C | T | A | G | C | A | C | G | C | - |
| AMADEUS | 8 | M | homozygous rf1, rf3, rf7 | G | G | G | C | G | - | T | - | A | - | C | C | - | G | C | A | C | T | A | G | C | A | C | G | C | G |

| | ANAPURNA | APACHE | ARKEOS | ARLEQUIN | ARTDECO | ARTURNICK | ATOMO | AVENUE |
|---|---|---|---|---|---|---|---|---|
| CODE | 9 | 10 | 11 | 12 | 13 | 14 | 15 | 16 |
| R: restorer / M: maintainer | M | M | M | M | M | M | M | M |
| Rf alleles | homozygous rf1, rf3, rf7 | homozygous rf1, rf3, rf7 | homozygous rf1, rf3, rf7 | homozygous rf1, rf3, rf7 | homozygous rf1, rf3, rf7 | homozygous rf1, rf3, rf7 | homozygous rf1, rf3, rf7 | homozygous rf1, rf3, rf7 |
| cfn1252000 | T | A | G | A | T | T | A | G |
| IWB14060* | G | G | A | G | A | G | G | G |
| cfn1249269 | G | G | A | - | A | A | G | G |
| 219K1_166464 | C | C | T | C | C | T | T | C |
| 219K1_158251 | G | G | G | G | - | G | G | - |
| 219K1_111446 | A | - | H | - | - | A | A | - |
| 219K1_110042 | T | T | H | T | T | C | C | T |
| 219K1_110005 | H | T | T | - | - | T | T | - |
| 219K1_107461 | A | A | A | A | - | A | A | A |
| 219K1_99688 | T | - | - | - | - | - | - | - |
| 219K1_37 | C | - | - | - | - | - | C | - |
| cfn1270524 | - | - | - | - | - | A | A | - |
| 136H5_3M5_7601 | C | C | C | C | C | C | C | C |
| cfn1288811 | G | - | - | - | - | G | G | - |
| 136H5_3M5_89176 | G | G | G | G | G | G | G | G |
| 136H5_3M5_89263 | C | C | C | C | C | C | C | C |
| 136H5_3M5_138211 | A | A | A | A | A | A | A | A |
| cfn0556874 | C | T | T | T | T | C | C | C |
| 136H5_3M5_64154 | T | C | C | C | C | T | T | T |
| 136H5_3M5_68807 | A | - | - | - | - | A | A | A |
| 136H5_3M5_779916 | H | - | - | - | - | G | G | G |
| cfn1246088 | C | C | C | C | C | C | C | C |
| cfn1287194 | H | H | G | H | H | A | A | A |
| cfn1258380 | C | - | - | - | - | C | C | C |
| IWB72107* | G | G | G | G | G | G | G | G |
| BS00090770 | T | C | C | C | C | T | C | C |
| cfn1239345 | G | G | G | G | A | T | A | A |

FIGURE 11C

| CODE | | R: restorer/M: maintainer | Rf alleles | cfn1252000 | IWB14060* | cfn1249269 | 219K1_166464 | 219K1_158251 | 219K1_111446 | 219K1_111042 | 219K1_110005 | 219K1_107461 | 219K1_99688 | 219K1_37 | cfn1270524 | 136H5_3M5_7601 | cfn1288811 | 136H5_3M5_89176 | 136H5_3M5_89263 | 136H5_3M5_138211 | cfn0556874 | 136H5_3M5_64154 | 136H5_3M5_68807 | 136H5_3M5_77916 | cfn1246088 | cfn1287194 | cfn1258380 | IWB72107* | BS00090770 | cfn1239345 |
|---|---|---|---|---|---|---|---|---|---|---|---|---|---|---|---|---|---|---|---|---|---|---|---|---|---|---|---|---|---|---|
| CEZANNE | 17 | M | homozygous rf1, rf3, rf7 | G | G | G | C | G | - | T | - | A | - | - | - | C | - | G | T | T | C | T | A | H | C | A | C | G | C | A |
| CROISADE | 18 | M | homozygous rf1, rf3, rf7 | G | G | G | T | G | A | C | T | A | - | - | A | C | G | G | C | A | C | T | A | G | C | A | C | G | C | A |
| FRUCTIDOR | 19 | M | homozygous rf1, rf3, rf7 | - | G | G | T | G | A | C | T | A | - | - | A | C | G | G | C | A | - | T | A | G | C | A | C | G | C | A |
| GAZUL | 20 | M | homozygous rf1, rf3, rf7 | G | A | A | T | H | - | T | - | A | - | - | T | C | - | G | C | A | - | C | - | - | C | H | - | G | C | A |
| HERMANN | 21 | M | homozygous rf1, rf3, rf7 | G | A | G | T | H | - | H | T | C | - | C | - | C | - | G | T | A | C | T | A | G | C | A | C | G | H | G |
| HORATIO | 22 | M | homozygous rf1, rf3, rf7 | G | A | A | T | G | - | T | T | H | - | - | - | C | - | G | C | A | T | C | - | - | C | H | - | G | C | H |
| KALAHARI | 23 | M | homozygous rf1, rf3, rf7 | G | A | G | T | G | - | T | - | H | - | - | - | C | - | G | C | A | C | T | A | G | C | A | C | G | C | A |

FIGURE 11D

FIGURE 12

```
RFL29a  AGGAAGGCCATGTAAGCAAGGCCTGCAATCTGTTCCATGAAATGGCGCAGCAGGGCGTTA
RFL29c  AGGAAGGCCATGTAAGCAAGGCCTGCAATCTGTTCCATGAAATGGCGCAGCAGGGCGTTA

RFL29a  AGCCTAATGTGGTGACATATAACTCAGTTATCGATGCGCTGTGCAAGGCCAGAGCCATGG
RFL29c  AGCCTAATGTGGTGACATATAACTCAGTTATCGATGCGCTGTGCAAGGCCAGAGCCATGG

RFL29a  ACAAGGCAGAGGTGGTCCTTCGTCAGATGATTGATGATGGTGTTGGACCTGATAATGTGA
RFL29c  ACAAGGCAGAGGTGGTCCTTCGTCAGATGATTGATGATGGTGTTGGACCT--TAATGTGA

RFL29a  CGTATAGTAGCCTCATCCATGGATATTCCTCTTCAGGCCACTGGAAGGAGGCAGTTAGGG
RFL29c  CGTATAGTAGCCTCATCCATGGATATTCCTCTTCAGGCCACTGGAAGGAGGCAGTTAGGG

RFL29a  TATTCAAAGAGATGACAAGTCGGAGGGTTACAGCAGATGTGCATACTTACAACATGTTTA
RFL29c  TATTCAAAGAGATGACAAGTCGGAGGGTTACAGCAGATGTGCATACTTACAACATGTTTA

RFL29a  TGACCTTTCTTTGCAAACATGGAAGAAGCAAAGAAGCTGCAGGAATTTTTGATACCATGG
RFL29c  TGACCTTTCTTTGCAAACATGGAAGAAGCAAAGAAGCTGCAGGAATTTTTGATACCATGG

RFL29a  CTATCAAGGGCCTGAAACCTGACAACGTTTCATATGCTATTCTCCTTCATGGGTATGCCG
RFL29c  CTATCAAGGGCCTGAAACCTGACAACGTTTCATATGCTATTCTCCTTCATGGGTATGCCG
```

WHEAT COMPRISING MALE FERTILITY RESTORER ALLELES

The present application contains a Sequence Listing that has been submitted electronically in ASCII format and is hereby incorporated by reference in its entirety. The ASCII copy, created on Dec. 8, 2020, is named Substitute Sequence Listing_ST25.txt and is 9,515,008 bytes in size.

The invention is in the field of plant genetics and plant breeding. The invention more specifically relates to wheat plants carrying restorer of fertility genes specific to *T. timopheevii* CMS cytoplasm.

BACKGROUND

Hybrid production is based on crossing two parental lines to increase heterosis and de facto, increase genetic variability to create new varieties or genotypes with higher yield and better adapted to environmental stresses. Even in a predominantly autogamous species like wheat, research studies have shown that hybrid lines exhibit improved quality and greater tolerance to environmental and biotic stresses.

In order to promote commercially viable rates of hybrid production, self-fertilization must be avoided, i.e. fertilization of the female organ by the pollen of the same plant. It is desired that the female organ of the female parent is exclusively fertilized with the pollen of the male parent. In order to obtain a reliable and efficient system for producing seeds needed for hybrid production, one generally needs three essential elements: a means to induce male sterility, a means to propagate the sterility, and a means to restore fertility. For example a fully genetically based system is composed of a male-sterile line (female parent), a fertile maintainer line (male parent allowing propagation of the male-sterile line), and a fertility restorer line (male parent for hybrid production).

Male sterility can be achieved by three different ways. Manual emasculation is the simplest one and is still used in some species where male and female flowers are separated, e.g. corn. However, it is impractical in species like wheat where flowers contain both female and male organs. Male sterility can also be induced by chemical hybridization agents (CHAs) with gametocidic effects. Currently, only a few commercial hybrid wheat cultivars are based on this technology as it can bear substantial financial risks.

Finally, male sterility can also be induced by genetic means. There are many examples of hybrid systems in corn or sorghum based on male sterility induced by genetic means showing the preponderance of this technology compared to the two mentioned previously. However, in other species which are predominantly self-pollinated like wheat, hybrid production is still a challenge (Longin et al, 2012).

The first case of male sterility in wheat was observed in 1951 (Kihara, 1951), where it was observed that sterility was caused by incompatibility between the cytoplasm of *Aegilops caudata* L. and the nucleus of *T. aestivum* var. *erythrospermum*. Subsequently research on *T. timopheevii* cytoplasm showed that this cytoplasm is able to induce sterility in bread wheat (*T. aestivum*) (Wilson and Ross, 1961, Crop Sci, 1:191-193). Orf256 was previously identified as a gene specific to the *T. timopheevii* mitochondrial genome (Rathburn and Hedgcoth, 1991; Song and Hedgcoth, 1994), however, it remains to be shown that orf256 is the genetic determinant of *T. timopheevii* CMS. It was expected that such a cytoplasm could be used in a hybrid production system. However, major limitations arose from the difficulty in finding a completely dominant and stable fertility restorer gene with no negative side effects (notably on yield).

Fertility restoration of male sterile plants harboring *T. timopheevii* CMS cytoplasm (T-CMS cytoplasm) has been reported and eight major restorer loci (designated as Rf1 to Rf8) have been identified and located approximate within the wheat genome. One of the most effective restorer loci is Rf3 (Ma and Sorrells, 1995; Kojima et al, 1997; Ahmed et al 2001; Geyer et al 2016). Two SNP markers allowed the location of the Rf3 locus within a 2 cM fragment on chromosome 1B (Geyer et al, 2016). The author notes that these markers are not diagnostic markers.

While it is understood that restoration to normal pollen fertility could require two or more Rf loci, it is also well known that modifier loci exist that have either minor effects with low penetrance (Zhou et al 2005, Stojalowski et al 2013) or inhibitory effects on fertility, depending on environmental conditions (Wilson, 1984). It is not yet understood which combination of genes or loci is needed to complete a full restoration of T-CMS in different genetic backgrounds and environmental conditions.

In this context, the development of technologies that enable a full restoration of pollen fertility is of major importance in wheat. It is therefore the object of this invention to propose suitable fertility restorer genes in wheat for the development of a hybrid production system useful for the seed industry.

SUMMARY

A first object of the present disclosure relates to an isolated Rf1 nucleic acid encoding a Rf1 protein restorer of fertility of *T. timopheevii* CMS cytoplasm, wherein the corresponding amino acid sequence has at least 95% identity, preferably at least 96%, 97%, 98%, 99% or 100% identity to SEQ ID NO:361. An example of Rf1 nucleic acid comprises SEQ ID NO:3119.

The disclosure also relates to a transgenic wheat plant comprising such Rf1 nucleic acid, and, optionally, one or more nucleic acids comprising Rf3, Rf4 and/or Rf7 restorer allele(s), as transgenic element(s).

Another aspect relates to a genetically engineered wheat plant comprising such Rf1 nucleic acid, and, optionally, one or more nucleic acids comprising Rf3, Rf4 and/or Rf7 restorer allele(s), as genetically engineered element(s).

in specific embodiments, said transgenic element(s) or genetically engineered element(s) express polypeptides which restore or improve male fertility to the plant as compared to the parent plant without such transgenic element(s) or genetically engineered element(s).

Yet another aspect relates to a wheat plant restorer of fertility of *T. timopheevii* CMS cytoplasm comprising such Rf1 restorer allele, and at least two fertility restorer alleles within the restorer loci chosen amongst Rf3, Rf4 and Rf7, wherein, the Rf3 locus is located at most 10 cM from marker cfn1249269 of SEQ ID NO: 3205 or marker BS00090770 of SEQ ID NO:3228, the Rf7 locus is located at most 10 cM from marker cfn0919993 of SEQ ID NO: 3231, and, the Rf4 locus is located at most 10 cM from marker cfn0393953 of SEQ ID NO: 3233.

The disclosure also provides methods for producing a transgenic wheat plant as described above, wherein the method comprises the steps of transforming a parent wheat plant with one or more Rf1 nucleic acids encoding protein restorer of *T. timopheevii* CMS cytoplasm, selecting a plant comprising said one or more nucleic acid(s) as transgene(s), regenerating and growing said wheat transgenic plant.

Also part of the present disclosure is a method for producing a genetically modified wheat plant as described above, wherein the method comprises the steps of genetically modifying a parent wheat plant to obtain in their genome one or more nucleotide sequence encoding Rf1 protein restorer of *T. timopheevii* CMS cytoplasm, preferably by genome-editing, selecting a plant comprising said one or more nucleotide sequences as genetically engineered elements, regenerating and growing said wheat genetically engineered plant.

The disclosure further relates to a method for producing a wheat plant by crossing, said method includes the following:

providing a first wheat plant comprising one or two restorer allele selected among Rf1, Rf3 and Rf7 restorer alleles, crossing said first wheat plant with a second wheat plant comprising one or two restorer alleles selected among Rf1, Rf3 and Rf7 restorer alleles, wherein Rf1, Rf3 and Rf7 restorer alleles are represented at least once in the panel of restorer alleles provided by the first plant and the second plant, collecting the F1 hybrid seed, obtaining homozygous plants from the F1 plants, optionally detecting the presence of the Rf1, Rf3 and Rf7 restorer alleles in the hybrid seed and/or at each generation.

Preferably in such methods, the fertility score of the obtained wheat plant has a fertility score higher than the parent wheat plant.

The disclosure also relates to a method for producing a transgenic or genetically engineered wheat plant, wherein the fertility level of said plant is modified, comprising the step of knocking-down Rf1 restorer allele expression, wherein said Rf1 restorer allele comprises a Rf1 nucleic acid.

The disclosure also relates to the method for producing a wheat hybrid plant comprising the steps of:

crossing a sterile female comprising the *T. timopheevii* cytoplasm with a fertile male wheat plant as described above;

collecting the hybrid seed;

optionally detecting hybridity level of the hybrid seeds.

The wheat hybrid plant as obtained by the above methods are also part of the present disclosure.

The present disclosure also relates to a method of identifying a wheat plant as described above, wherein said wheat plant is identified by detecting the presence of at least one restorer allele Rf1 and, optionally, one or more further restorer alleles selected from the group consisting of Rf3, Rf4 and Rf7.

Accordingly, nucleic acid probes or primers for the specific detection of the restorer allele Rf1 in a wheat plant, and, optionally, one or more of the Rf3, Rf4, and Rf7 restorer alleles, are also disclosed herein.

Another aspect of the disclosure relates to a recombinant nucleic acid comprising a Rf1 nucleic acid encoding a Rf1 protein restorer of *T. timopheevii* CMS cytoplasm, operably linked to regulatory elements and the vectors for use in transformation of a wheat plant, comprising such recombinant nucleic acids.

DETAILED DESCRIPTION

Nucleic Acids of the Present Disclosure

An aspect of the present disclosure relates to the cloning and characterization of genes encoding restorer of fertility proteins that act on *T. timopheevii* CMS cytoplasm (hereafter referred as Rf genes or nucleic acids) in wheat plants and the use of the corresponding Rf nucleic acids for producing transgenic wheat plants, for modifying wheat plants by genome editing, and/or for detecting such Rf genes in wheat plants.

Whenever reference to a "plant" or "plants" is made, it is understood that also plant parts (cells, tissues or organs, seed pods, seeds, severed parts such as roots, leaves, flowers, pollen, etc.), progeny of the plants which retain the distinguishing characteristics of the parents (especially, male fertility associated with the claimed Rf nucleic acids), such as seed obtained by selfing or crossing, e.g. hybrid seeds (obtained by crossing two inbred parent plants), hybrid plants and plant parts derived therefrom are encompassed herein, unless otherwise indicated.

As used herein, the term "wheat plant" refers to species of the genus *Triticum* as for example, *T. aestivum, T. aethiopicum, T. araraticum, T. boeoticum, T. carthlicum, T. compactum, T. dicoccoides, T. dicoccon, T. durum, T. ispahanicum, T. karamyschevii, T. macha, T. militinae, T. monococcum, T. polonicum, T. spelta, T. sphaerococcum, T. timopheevii, T. turanicum, T. turgidum, T. urartu, T. vavilovii, T. zhukovskyi* Faegi. Wheat plant also refers to species of the genera *Aegilops* and Triticale.

As used herein, the term "restorer of fertility of *T. timopheevii* CMS cytoplasm" refers to a protein whose expression in a wheat plant comprising *T. timopheevii* CMS cytoplasm contributes to the restoration of the production of pollen in the *Triticum timopheevii* CMS system.

As used herein, the term "allele(s)" means any of one or more alternative forms of a gene at a particular locus. In a diploid, alleles of a given gene are located at a specific location or locus on a chromosome. One allele is present on each chromosome of the pair of homologous chromosomes. The same definition is used for plants bearing a higher level of ploidy like in *Triticum* gender wherein, for example, *T. aestivum* is an hexaploid plant.

As used herein, the term "restorer allele of *T. timopheevii* CMS cytoplasm" refers to an allele which contributes to the restoration of the production of pollen in the CMS *Triticum timopheevii* system.

The restoration of pollen fertility may be partial or complete. The pollen fertility can be evaluated by the pollen fertility tests as described in the Examples below. In particular, the fertility score of F1 wheat plants having CMS-*T timopheevii* cytoplasm (from test restorer line with CMS hybrids) may be calculated by dividing the total number of seeds threshed from a spike by the number of counted spikelets and may be compared with the fertility scores of a panel of control fertile plants, for example elite inbred lines bearing a normal wheat cytoplasm, grown in the same area and under the same agro-environmental conditions. It is preferred that such panels of lines comprise a set of at least 5 elite inbred lines wherein these lines are representative of the area where the fertility test is achieved. Besides, it is preferred that at least 10 spikes from different individual F1 plants be assessed for a given experiment.

If the fertility score is not null, then the plant has acquired partial or full restoration of fertility. For each fertility score, a statistical test is calculated to obtain a p-value. Examples of statistical tests are the Anova or mean comparison tests. A p-value below a 5% threshold will indicate that the two distributions are statistically different. Therefore, a significant decrease of the fertility score of the tested wheat plant as compared to the fertility score of the fully fertile control plant is indicative that the F1 plant has not acquired full restoration of fertility (i.e. partial restoration). A similar or higher fertility score is indicative that the F1 plant has acquired full restoration of fertility. In a preferred embodiment, the wheat plant, such as transgenic or genetically engineered wheat plant, according to the present disclosure, has acquired full restoration of fertility.

The loci of the restorer alleles of *T. timopheevii* CMS cytoplasm within Rf1, Rf3, Rf4 and Rf7 have been mapped in the present disclosure. The corresponding restorer alleles are designated Rf1, Rf3, Rf4 and Rf7 restorer alleles and have been described in the art. In particular, a wheat plant source of the Rf3 restorer allele includes the commercial following lines: Allezy, Altigo, Altamira, see table 15. A wheat plant source of the Rf4 restorer allele includes the following lines: R113 or L13.

In specific embodiments, representative alleles of Rf1, Rf3, Rf4 and Rf7 restorer alleles are provided by the seed sample chosen amongst: NCIMB 42811, NCIMB 42812, NCIMB 42813, NCIMB 42814, NCIMB 42815, NCIMB 42816, and NCIMB 42817.

As used herein, the term "centimorgan" ("cM") is a unit of measure of recombination frequency. One cM is equal to a 1% chance that a marker at one genetic locus will be separated from a marker at a second locus due to crossing over in a single generation.

As used herein, the term "chromosomal interval" designates a contiguous linear span of genomic DNA that resides in planta on a single chromosome. The genetic elements or genes located on a single chromosomal interval are physically linked. The size of a chromosomal interval is not particularly limited. In some aspects, the genetic elements located within a single chromosomal interval are genetically linked, typically with a genetic recombination distance of, for example, less than or equal to 20 cM, or alternatively, less than or equal to 10 cM. That is, two genetic elements within a single chromosomal interval undergo recombination at a frequency of less than or equal to 20% or 10%.

The present disclosure provides nucleic acids and their recombinant forms comprising the coding sequence of either Rf1, Rf3, Rf4, Rf7 or Rf-rye restorer of fertility proteins active in *T. timopheevii* CMS cytoplasm.

As used herein, a "recombinant nucleic acid" is a nucleic acid molecule, preferably a DNA molecule, comprising a combination of nucleic acid molecules that would not naturally occur together and is the result of human intervention, e.g., a DNA molecule that is comprised of a combination of at least two DNA molecules heterologous to each other, and/or a DNA molecule that is artificially synthesized and comprises a polynucleotide sequence that deviates from the polynucleotide sequence that would normally exist in nature.

Such nucleic acids encoding candidate restorer of fertility proteins of *T. timopheevii* CMS cytoplasm have been isolated as described in the Examples below. Accordingly, a first aspect of the disclosure are nucleic acids encoding a protein restorer of fertility of *T. timopheevii* having an amino acid sequence at least 95% identical, typically at least 96% identical, to an amino acid sequence chosen amongst any one of SEQ ID NO:1 to SEQ ID NO: 1554.

Percentage of sequence identity as used herein is determined by calculating the number of matched positions in aligned amino acid sequences, dividing the number of matched positions by the total number of aligned amino acids, and multiplying by 100. A matched position refers to a position in which identical amino acids occur at the same position in aligned amino acid sequences. For example, amino acid sequences may be aligned using the CD-hit (settings-c 0.96-n 5-G 0-d 0-AS 60-A 105-g 1, see http://weizhongli-lab.org/cd-hit/).

The above candidate nucleic acids encoding any one of polypeptides SEQ ID NO: 1 to 1554, can further be assessed for their capacity to restore fertility of sterile wheat plant as described below.

It is therefore disclosed herein a method for assessing the capacity of a nucleic acid to restore fertility, wherein the method comprises the steps of:
a. introducing one or more candidate Rf1, Rf3, Rf4, Rf7 and/or Rf-rye nucleic acid encoding a putative amino acid sequence of at least 95% identical to any one of SEQ ID NO 1 to SEQ ID NO 1554 into a parent wheat sterile plant and *T. timopheevii* CMS cytoplasm,
b. selecting the transgenic plant bearing one or more candidate nucleic acid as transgene(s), and
c. evaluating the fertility of the transgenic plants as compared to the parent wheat sterile plant based on a fertility restoration assay, wherein an improvement in the fertility restoration is indicative that said nucleic acid has the capacity to restore fertility.

In a specific embodiment, the parent wheat sterile plant is the Fielder line bearing the *T. timopheevii* CMS cytoplasm.

In another specific embodiment of the above method, the Rf1, Rf3, Rf4, Rf7 and/or Rf-rye candidate nucleic acid sequence is selected from those encoding an amino acid sequence having at least 95% identity, or at least 96% identity, for example 100% identity, to any one of SEQ ID NO 1 to SEQ ID NO 1554.

Typically, the Rf1, Rf3, Rf4, Rf7 and/or Rf-rye candidate nucleic acids are selected among the following nucleic acids of SEQ ID NO: 1555 to SEQ ID NO:3107 and 3133.

In a further specific embodiment, where appropriate, the nucleic acid sequence may be optimized for increased expression in the transformed plant. There are a number of optimizations that can be performed at the DNA level, without changing the protein sequence, by conservative codon exchanges which replace one codon by another codon encoding the same amino acid. Besides, the nucleic acid sequence can be modified for cloning purpose. Like for optimization, such modification is achieved without changing the protein sequence.

Rf1 Nucleic Acids

In specific embodiment, the nucleic acid of the present disclosure is a Rf1 nucleic acid.

As used herein, the term "Rf1 nucleic acid" refers to a nucleic acid comprising a gene encoding a Rf1 protein restorer of fertility of *T. timopheevii* CMS cytoplasm, wherein the corresponding amino acid sequence has at least 95% identity, preferably, 96%, 97%, 98%, 99% or 100% identity to an amino acid sequence selected from the group consisting of SEQ ID NOs 1-2, SEQ ID NOs 288-290, SEQ ID NOs 293-296, SEQ ID NOs 343-346, SEQ ID NOs 349-354, SEQ ID NOs 359, 361 and 362, SEQ ID NOs 396 and 397, SEQ ID NOs 428-430, SEQ ID NO 517 and 519, SEQ ID NOs 752-754, SEQ ID NOs 1092, 1093 and 1095, typically, SEQ ID NOs 359, 361 and 362 and SEQ ID NO 428-430. In a particularly preferred embodiment, the Rf1 nucleic acid encodes an amino acid sequence having at least 95% identity, preferably, 96%, 97%, 98%, 99% or 100% identity to SEQ ID NO:361. Examples of corresponding specific Rf1 nucleic acids are referred to in Table 7.

In particular, and as shown in Example 6, the inventors have identified that RFL79 sequence of SEQ ID NO:361 (as depicted in Table 7) can restore male fertility of CMS-Fielder plants. Accordingly, in a preferred embodiment, examples of Rf1 nucleic acids comprises the disclosed Rf1 nucleic acid sequences of SEQ ID NO:1913, SEQ ID NO:1914, SEQ ID NO: 1915, SEQ ID NO: 1916 or SEQ ID NO:3119, preferably a Rf1 nucleic acid comprises SEQ ID NO:3119.

Rf3 Nucleic Acids

In specific embodiment, the nucleic acid of the present disclosure is a Rf3 nucleic acid.

As used herein, the term "Rf3 nucleic acid" refers to a nucleic acid comprising a gene encoding a Rf3 protein restorer of fertility of *T. timopheevii* CMS cytoplasm, wherein the corresponding amino acid sequence has at least 95% identity, preferably, 96%, 97%, 98%, 99% or 100% identity to an amino acid sequence selected from the group consisting of SEQ ID NOs: 124 and 125, SEQ ID NO:147, SEQ ID NO:150, SEQ ID NO: 156, SEQ ID NO: 158, SEQ ID NO:297, SEQ ID NO:299, SEQ ID NOs: 315-321, SEQ ID NOs: 379-381, SEQ ID NOs: 553 and 554, SEQ ID NOs: 557 and 558, SEQ ID NOs: 676 and 677, SEQ ID NOs: 684 and 685, SEQ ID NOs: 696 and 697, SEQ ID NOs: 938 and 939 and SEQ ID NOs: 1038 and 1039, typically, SEQ ID NOs: 315-321, SEQ ID NOs: 379-381, SEQ ID NOs: 147 and 150, SEQ ID NOs: 156 and 158, SEQ ID NOs 297 and 299. Preferred Rf3 nucleic acids encode a Rf3 protein restorer of fertility of *T. timopheevii* CMS cytoplasm, with the corresponding amino acid sequence having at least 95% identity, preferably, 96%, 97%, 98%, 99% or 100% identity to an amino acid sequence selected from the group consisting of SEQ ID NO: 158, SEQ ID NO:676 and SEQ ID NO:684. Examples of corresponding specific Rf3 nucleic acids are referred to in Table 7 or further described in Example 12. Typically, examples of specific Rf3 nucleic acids comprises SEQ ID NO:1712, SEQ ID NO:2230, SEQ ID NO: 2238, SEQ ID NO:3146, SEQ ID NO:3147 or SEQ ID NO:3148.

Rf4 Nucleic Acids

In specific embodiment, the nucleic acid of the present disclosure is a Rf4 nucleic acid.

As used herein, the term "Rf4 nucleic acid" refers to a nucleic acid comprising a gene encoding a Rf4 protein restorer of fertility of *T. timopheevii* CMS cytoplasm, wherein the corresponding amino acid sequence has at least 95% identity, preferably, 96%, 97%, 98%, 99% or 100% identity to an amino acid sequence selected from the group consisting of SEQ ID NO:477, and SEQ ID NOs 3135-3138, typically SEQ ID NO:477 and SEQ ID NOs 3136-3138. Examples of corresponding specific Rf4 nucleic acids are listed in Table 7 and further include any of SEQ ID NO: 2031, and SEQ ID NO:3140-3142.

Rf7 Nucleic Acids

In specific embodiment, the nucleic acid of the present disclosure is a Rf7 nucleic acid.

As used herein, the term "Rf7 nucleic acid" refers to a nucleic acid comprising a gene encoding a Rf7 protein restorer of fertility of *T. timopheevii* CMS cytoplasm, wherein the corresponding amino acid sequence has at least 95% identity, preferably, 96%, 97%, 98%, 99% or 100% identity to an amino acid sequence selected from the group consisting of SEQ ID NOs: 240-243, SEQ ID NOs 303-305, SEQ ID NO:363, SEQ ID NOs 375-377, SEQ ID NOs 497-499, SEQ ID NO:516, SEQ ID NOs 709-711, SEQ ID NO: 768, typically SEQ ID NO:363, SEQ ID NO:516 and SEQ ID NO:768. Examples of corresponding specific Rf7 nucleic acids are referred to in Table 7.

Rf-Rye Nucleic Acids

In specific embodiment, the nucleic acid of the present disclosure is a Rf-rye nucleic acid.

As used herein, the term "Rf-rye nucleic acid" refers to a nucleic acid comprising a gene encoding a Rf-rye protein restorer of fertility of *T. timopheevii* CMS cytoplasm, wherein the corresponding amino acid sequence has at least 95% identity, preferably, 96%, 97%, 98%, 99% or 100% identity to an amino acid sequence selected from the group consisting of SEQ ID NO:227, SEQ ID NO:378 and SEQ ID NO:859. Examples of corresponding specific Rf-rye nucleic acids are referred to in Table 7.

Rf Nucleic Acids as Transgene

The present disclosure more specifically relates to DNA molecules including one or more of the Rf1, Rf3, Rf4, Rf7 or Rf-rye nucleic acids. In particular, the disclosure relates to any DNA molecule resulting from the insertion of a transgene in the wheat plant, said transgene including one or more of the above described Rf1, Rf3, Rf4, Rf7 or Rf-rye nucleic acids, and which insertion results in the expression of corresponding RNA and/or protein in the wheat plant.

Also part of the present disclosure is a nucleic acid that has been extracted from cells, or tissues, or homogenate from a plant or seed or plant tissue; or can be produced as an amplicon from extracted DNA or RNA from cells, or tissues, or homogenate from a plant or seed or plant tissue, any of which is derived from such materials derived from a plant comprising such nucleic acid as disclosed above.

As used herein, the term "transgene" or "transgenic element" refers to the nucleic acid (e.g. DNA molecule) incorporated into a host cell's genome. The term "transgene" or 'transgenic element" refers in particular to a sequence that is not normally present in a given host genome in the genetic context in which the sequence is currently found. In this respect, the sequence may be native to the host genome, but be rearranged with respect to other genetic sequences within the host genomic sequence. For example, the transgene is rearranged at a different locus as compared to the native gene.

Said one or more transgenic element(s) enables the expression of polypeptides which restore or improve male fertility to the plant having *T. timopheevii* CMS cytoplasm, as compared to the parent plant which do not comprise the transgenic element.

A particular transgenic element is the recombinant nucleic acid as defined above, for example Rf1 nucleic acids as defined above. In specific embodiments, a transgenic element includes an Rf nucleic acid under the control of a constitutive promoter, such as the ZmUbi promoter.

Recombinant Nucleic Acids for Use in Transforming Wheat Plants

Such Rf nucleic acids as defined above are also useful to transform or genetically modify wheat plant, in particular wheat plant which does not have one or more of the fertility restoration alleles Rf1, Rf3, Rf4, Rf7 and Rf-rye.

Another aspect of the present disclosure relates to a vector for use in transforming wheat plant, comprising one or more of Rf1, Rf3, Rf4, Rf7 and Rf-rye nucleic acids as described above.

Vectors for use in transforming wheat plant includes at least the coding sequence of the corresponding protein restorer of fertility (either naturally occurring coding sequence, or improved sequence, such as codon optimized sequence), such coding sequence being operably linked to a regulatory element such as a promoter.

The term "promoter" as used herein refers to a region of DNA upstream of the coding sequence (upstream of start codon) and including DNA regions for recognition and binding of RNA polymerase and other proteins to initiate transcription at the start codon. Examples of constitutive promoters useful for expression include the 35S promoter or the 19S promoter (Kay et al, 1987), the rice actin promoter (McElroy et al, 1990), the pCRV promoter (Depigny-This et al, 1992), the CsVMV promoter (Verdaguer et al. 1996), the ubiquitin 1 promoter of maize (Christensen and Quail, 1996), the regulatory sequences of the T-DNA of *Agrobacterium tumefaciens*, including mannopine synthase, nopaline synthase, octopine synthase.

Promoters may be «tissue-preferred», i.e. initiating transcription in certain tissues or "tissue-specific", i.e. initiating transcription only in certain tissues. Examples of such promoters are DHN12, LTR1, LTP1 specific of the embryo, SS1 specific of the phloem, OSG6B specific of the tapetum (Gotz et al 2011 and Jones 2015).

Other suitable promoters could be used. It could be an inducible promoter, a developmentally regulated promoter. An "inducible" promoter initiates transcription under some environmental control or any stress-induced like for example the abiotic stress-induced RD29, COR14b (Gotz et al, 2011).

Constitutive promoters may be used, such as the ZmUbi promoter, typically the ZmUbi promoter of SEQ ID NO:3134. Finally, promoter of SEQ ID NO:3114, SEQ ID NO:3123 and SEQ ID NO:3113 corresponding to pTaRFL46, 79 and 104 can also be used.

In specific embodiments, the Rf1, Rf3, Rf4, Rf7 or Rf-rye nucleic acids of the present disclosure are operably linked to heterologous promoters, i.e. a promoter which is not the natural promoter of the corresponding Rf1, Rf3, Rf4, Rf7 or Rf-rye nucleic acids as found in wheat. Typical recombinant constructs of Rf3 nucleic acids with heterologous promoters include any one of SEQ ID NO:3150-3153, and any one of SEQ ID NO: 3156-SEQ ID NO:3159. Typical recombinant constructs of Rf1 nucleic acids with heterologous promoters includes SEQ ID NO:3122, or a nucleic acid of SEQ ID NO: 3119 under the regulation of the promoter of SEQ ID NO:2123.

The vector may further comprise additional elements including selection gene marker, operably linked to regulatory element, that allows to select the transformed plant cells containing the vector, comprising the nucleic acids of the present disclosure as transgene.

The vector may further comprise additional elements including counter-selection gene marker, operably linked to regulatory element that allows to counter-select the transformed plant cells which do not have maintained the counter-selection gene marker in its genome.

In a specific embodiment, the vector according to the present disclosure may be vector suitable for *Agrobacterium*-mediated transformation, in particular *Agrobacterium tumefaciens* or *Agrobacterium rhizogenes* mediated transformation, as described in the next section.

Methods for Producing a Wheat Transgenic Plant

Another aspect of the present disclosure relates to the use of the above-described nucleic acids for producing wheat transgenic plant expressing protein restorer of fertility.

The term "transgenic plant" refers to a plant comprising such a transgene. A "transgenic plant" includes a plant, plant part, a plant cell or seed whose genome has been altered by the stable integration of recombinant DNA. A transgenic plant includes a plant regenerated from an originally-transformed plant cell and progeny transgenic plants from later generations or crosses of a transformed plant. As a result of such genomic alteration, the transgenic plant is distinctly different from the related wild type plant. An example of a transgenic plant is a plant described herein as comprising one or more of the Rf1, Rf3, Rf4, Rf7 or Rf-rye nucleic acids, typically as transgenic elements. For example, the transgenic plant includes one or more Rf1, Rf3, Rf4, Rf7 or Rf-rye nucleic acids as transgene, inserted at loci different from the native locus of the corresponding Rf gene(s). Accordingly, it is herein disclosed a method for producing a wheat transgenic plant, wherein the method comprises the steps of (i) transforming a parent wheat plant with Rf1, Rf3, Rf4, Rf7 and/or Rf-rye nucleic acids, (ii) selecting a plant comprising said one or more nucleic acid(s) as transgene(s), (iii) regenerating and (iv) growing said wheat transgenic plant.

For transformation methods within a plant cell, one can cite methods of direct transfer of genes such as direct micro-injection into plant embryos, vacuum infiltration or electroporation, direct precipitation by means of PEG or the bombardment by gun of particles covered with the plasmidic DNA of interest.

It is preferred to transform the plant cell with a bacterial strain, in particular *Agrobacterium*, in particular *Agrobacterium tumefaciens*. In particular, it is possible to use the method described by Ishida et al. (Nature Biotechnology, 14, 745-750, 1996) for the transformation of monocotyledons.

Descriptions of *Agrobacterium* vector systems and methods for *Agrobacterium*-mediated gene transfer are provided by Moloney et al., Plant Cell Reports 8:238 (1989). See also, U.S. Pat. No. 5,591,616 issued Jan. 7, 1997.

Alternatively, direct gene transfer may be used. A generally applicable method of plant transformation is microprojectile-mediated transformation wherein DNA is carried on the surface of microprojectiles measuring 1 to 4 micron. The expression vector is introduced into plant tissues with a biolistic device that accelerates the microprojectiles to speeds of 300 to 600 m/s which is sufficient to penetrate plant cell walls and membranes. Sanford et al., Part. Sci. Technol. 5:27 (1987), Sanford, J. C., Trends Biotech. 6:299 (1988), Klein et al., BioTechnology 6:559-563 (1988), Sanford, J. C., Physiol Plant 7:206 (1990), Klein et al., BioTechnology 10:268 (1992). Several target tissues can be bombarded with DNA-coated microprojectiles in order to produce transgenic plants, including, for example, callus (Type I or Type II), immature embryos, and meristematic tissue.

Following transformation of wheat target tissues, expression of the selectable marker genes allows for preferential selection of transformed cells, tissues and/or plants, using regeneration and selection methods now well known in the art.

The foregoing methods for transformation would typically be used for producing a transgenic plant including one or more of Rf1, Rf3, Rf4, Rf7 or Rf Rye nucleic acids as transgenic element(s).

The transgenic plant could then be crossed, with another (non-transformed or transformed) inbred line, in order to produce a new transgenic line. Alternatively, a genetic trait which has been engineered into a particular line using the foregoing transformation techniques could be moved into another line using traditional backcrossing techniques that are well known in the plant breeding arts. For example, a backcrossing approach could be used to move an engineered trait from a public, non-elite inbred line into an elite inbred line, or from an inbred line containing a foreign gene in its genome into an inbred line or lines which do not contain that gene. As used herein, "crossing" can refer to a simple X by Y cross, or the process of backcrossing, depending on the context.

When the term transgenic wheat plant is used in the context of the present disclosure, this also includes any wheat plant including, as a transgenic element one or more of Rf1, Rf3, Rf4, Rf7 or Rf-rye nucleic acids and wherein one or more desired traits have further been introduced through backcrossing methods, whether such trait is a naturally occurring one or a transgenic one. Backcrossing methods can be used with the present invention to improve or introduce one or more characteristic into the inbred. The term backcrossing as used herein refers to the repeated crossing of a hybrid progeny back to one of the parental wheat plants. The parental wheat plant which contributes the gene or the genes for the desired characteristic is termed the nonrecurrent or donor parent. This terminology refers to the fact that the nonrecurrent parent is used one time in the backcross protocol and therefore does not recur. The parental wheat plant to which the gene or genes from the nonrecurrent parent are transferred is known as the recurrent parent as it is used for several rounds in the backcrossing protocol (Fehr et al, 1987).

In a typical backcross protocol, the recurrent parent is crossed to a second nonrecurrent parent that carries the gene or genes of interest to be transferred. The resulting progeny from this cross are then crossed again to the recurrent parent and the process is repeated until a wheat plant is obtained wherein all the desired morphological and physiological characteristics of the recurrent parent are recovered in the converted plant in addition to the gene or genes transferred from the nonrecurrent parent. It should be noted that some, one, two, three or more, self-pollination and growing of a population might be included between two successive backcrosses.

Methods for Producing a Wheat Genetically Engineered Plant

An aspect of the present disclosure relates to a DNA fragment of the corresponding protein restorer of fertility (either naturally occurring coding sequence, or improved sequence, such as codon optimized sequence) combined with genome editing tools (such TALENs, CRISPR-Cas, Cpf1 or zing finger nuclease tools) to target the corresponding Rf restorer alleles within the wheat plant genome by insertion at any locus in the genome or by partial or total allele replacement at the corresponding locus. In particular, the disclosure relates to a genetically modified (or engineered) wheat plant, wherein the method comprises the steps of genetically modifying a parent wheat plant to obtain in their genome one or more nucleotide sequence encoding protein restorer of T. timopheevii CMS cytoplasm Rf1, Rf3, Rf4 or Rf7 as disclosed herein, preferably by genome-editing, selecting a plant comprising said one or more nucleotide sequences as genetically engineered elements, regenerating and growing said wheat genetically engineered plant.

As used herein, the term "genetically engineered element" refers to a nucleic acid sequence present in the genome of a plant and that has been modified by mutagenesis or by genome-editing tools, preferentially by genome-editing tools. In specific embodiments, a genetically engineered element refers to a nucleic acid sequence that is not normally present in a given host genome in the genetic context in which the sequence is currently found but is incorporated in the genome of plant by use of genome-editing tools. In this respect, the sequence may be native to the host genome, but be rearranged with respect to other genetic sequences within the host genomic sequence. For example, the genetically engineered element is a gene that is rearranged at a different locus as compared to a native gene. Alternatively, the sequence is a native coding sequence that has been placed under the control of heterologous regulatory sequences. Other specific examples are described hereafter. The term "genetically engineered plant" or "genetically modified plant" refers to a plant comprising such genetically engineered element. A "genetically engineered plant" includes a plant, plant part, a plant cell or seed whose genome has been altered by the stable integration of recombinant DNA. As used herein, the term "genetically engineered plant" further includes a plant, plant part, a plant cell or seed whose genome has been altered by genome editing techniques. A genetically engineered plant includes a plant regenerated from an originally-engineered plant cell and progeny of genetically engineered plants from later generations or crosses of a genetically engineered plant. As a result of such genomic alteration, the genetically engineered plant is distinctly different from the related wild type plant. An example of a genetically engineered plant is a plant described herein as comprising one or more of the Rf1, Rf3, Rf4, Rf7 or Rf-rye nucleic acids. For example, the genetically engineered plant includes one or more Rf1, Rf3, Rf4, Rf7 or Rf-rye nucleic acids as genetically engineered elements, inserted at loci different from the native locus of the corresponding Rf gene(s).

In specific embodiments, said genetically engineered plants do not include plants which could be obtained exclusively by means of an essentially biological process.

Said one or more genetically engineered element(s) enables the expression of polypeptides which restore or improve male fertility to the plant having T. timopheevii CMS cytoplasm, as compared to the parent plant which do not comprise the genetically engineered element(s).

A particular genetically engineered element is the Rf nucleic acid as defined above, for example Rf1 nucleic acids as defined above. In specific embodiments, a genetically engineered element includes an Rf nucleic acid under the control of expression elements as promoter and/or terminator. Suitable promoter can be a constitutive promoter, such as the ZmUbi promoter or an endogenous Rf promoter native or modified.

Another aspect of the disclosure relates to a genetically engineered wheat plant, which comprises the modification by point mutation insertion or deletion of one or few nucleotides of an allele sequence rf or Rf, as genetically engineered element, into the respectively Rf or rf allele, by any of the genome editing tools including base-editing tool as described in WO2015089406 or by mutagenesis.

The present disclosure further includes methods for modifying fertility level in a plant by genome editing, comprising providing a genome editing tool capable of replacing partially or totally a rf1, rf3, rf4, rf7 or rf-rye non-restorer allele sequence or form in a wheat plant by its corresponding Rf1, Rf3, Rf4, Rf7 or Rf-rye restorer allele sequence as disclosed herein.

The term "rf non-restorer allele sequence or form" can be related to the presence in the genome of a rf non-restorer allele or to the absence in the genome of any rf or Rf allele. For example, in the rf3/Rf3 system, one wheat non-restorer line can be characterized by the presence of a rf3 allele sequence while another non-restorer line is characterized by the absence of any Rf3 or rf3 allelic sequence. The Rf3 restorer plant will be characterized by the presence of the Rf3 allele sequence in the genome. In the case of the rf4/Rf4 system, the non-restorer plant is characterized by the absence of any rf4 or Rf4 allelic forms while the Rf4 restorer plant will be characterized by the presence in the genome of the Rf4 gene sequence.

In specific embodiments, methods for modifying fertility level in a plant by genome editing comprises providing a genome editing tool capable of replacing or modifying a rf3 non-restorer allele to obtain a Rf3 restorer allele comprising SEQ ID NO:3146 (RFL29a). In other specific embodiments, rf3 non-restorer allele may comprise RFL29c characterized by a frameshift compared to RFL29a nucleotide sequence as shown in Example 22 and FIG. 12 and SEQ ID NO:3457.

The disclosure further includes methods for modifying fertility level in a plant introducing the endogenous promoter of a restorer Rf gene in order to increase the expression of the corresponding endogenous Rf gene either by genome-editing or by mutagenesis.

In a specific embodiment, the disclosure includes methods for modifying fertility level in a plant by genome editing of a weak fertile plant by modifying the 5'UTR sequence of the Rf3 "weak" RFL29b allele which 5'UTR region includes a 163 bp insertion to be deleted as shown in example 15.

In a further specific embodiment, the invention includes a method for modifying fertility level in a plant by mutagenesis or by genome editing the endogenous promoter of a restorer Rf gene in order to increase the expression of the endogenous Rf gene. As an example, the sequence of proTaRFL79 depicted in SEQ ID N°3123 could be mutated or edited to increase RFL79 protein level.

In another specific embodiment, whenever a stronger promoter is located upstream to the promoter of the Rf restorer gene, a deletion of that promoter and the region upstream can be achieved in order to juxtapose the stronger promoter to the Rf gene.

In a specific embodiment, one rf non-restorer allele is replaced partially or totally by anyone of the Rf1, Rf3, Rf4, Rf7 or Rf-rye restorer allele. In such disclosure, a non-restorer rf1 allele could be replaced, for example, by a Rf3, or a Rf4, or a Rf7, or Rf-rye allele.

In another aspect of the disclosure, at least one restorer allele from among Rf1, Rf3, Rf4, Rf7 and Rf-Rye can be integrated at one or more target sites in the wheat plant genome, typically in order to get an expression of said restorer alleles. Said expression can be achieved either by taking advantage of the presence at the targeting locus of a promoter, more specifically a strong promoter, and/or a terminator and by targeting with the Rf allele said expression elements. In a specific embodiment, the endogenous Rf allele is deleted from one first locus and further integrated downstream a suitable promoter at a second locus in the same plant genome.

In a specific embodiment of the invention, the target sites can be located in the Rf1, Rf3, Rf4 and/or Rf7 locus as defined in example 17. In a more specific embodiment, the target sites can either be the Rf1, Rf3, Rf4, Rf7 or Rf-Rye endogenous gene sequence or any other target sites different from the Rf1, Rf3, Rf4, Rf7 or Rf-Rye endogenous gene sequences.

In a preferred aspect of the disclosure, a wheat plant can comprise in its genome, at only one locus, the Rf1, Rf3 and Rf7 restorer alleles.

Such genome editing tool includes without limitation targeted sequence modification provided by double-strand break technologies such as, but not limited to, meganucleases, ZFNs, TALENs (WO2011072246) or CRISPR CAS system (including CRISPR Cas9, WO2013181440), Cpf1 or their next generations based on double-strand break technologies using engineered nucleases.

Method for Decreasing the Fertility Level in Wheat Plant:

Alternatively, the present disclosure further includes methods for modifying fertility level in a plant by reverting a restorer line comprising a Rf allele to a maintainer line comprising a rf allele. Such method could be used for any plant comprising a Rf allele, including Rf1. It is of particular interest in the case of a hybrid production system based on Rf3 restorer allele, wherein for example, the Rf3 sequence is RFL29a and the rf3 sequence is RFL29c.

The decrease in fertility could be obtained by knocking-down Rf gene or allele as described below.

More specifically, the method can correspond first to an inhibition of the expression by RNAi directed against the Rf allele of interest or by impairing the promoter function of the Rf allele either by mutagenesis or by genome editing.

In another aspect, the fertility level decrease is obtained by mutagenesis, classically induced with mutagenic agents, or by genome editing technologies to impair the protein function, by deleting totally or partially the gene, or by modifying the gene sequence reading frame to impair protein translation.

In a further aspect, the disclosure relates to the transgenic or genetically engineered wheat plant with decreased fertility level obtained by the methods described above.

The Transgenic or Genetically Engineered Wheat Plant of the Present Disclosure

Another aspect of the present disclosure relates to a transgenic or genetically engineered wheat plant comprising one or more Rf1, Rf3, Rf4, Rf7 or Rf-rye nucleic acid(s) as described in the previous sections, as transgenic or genetically engineered elements respectively.

Said transgenic or genetically engineered plant may be obtained by the methods described in the previous section.

The transgenic or genetically engineered plants of the present disclosure may advantageously be used as parent plant in order to produce fertile wheat transgenic or genetically engineered plant restorer of *T. timopheevii* CMS cytoplasm. In particular, in specific embodiment, the wheat transgenic or genetically engineered plant is a fertile wheat transgenic or genetically engineered plant restorer of *T. timopheevii* CMS cytoplasm. Typically, a transgenic or genetically engineered wheat plant according to the present disclosure comprises a combination of at least two different transgenic or genetically engineered elements selected from the group consisting of Rf1, Rf3, Rf4, Rf7 and Rf-rye encoding nucleic acids.

The transgenic or genetically engineered wheat plant as disclosed herein may express such protein restorer of fertility Rf1, Rf3, Rf4, Rf7 and/or Rf-Rye together as the result of the transgene's expression or expression of the genetically engineered element and may additionally express other protein restorer of fertility, as the result of naturally occurring alleles.

In one embodiment, said combination of at least two, three or four of Rf1, Rf3, Rf4, Rf7 and Rf-rye nucleic is found in the same locus in the genome of the transgenic or genetically engineered plant. In other embodiments, the corresponding nucleic acids of the combination are located in distinct loci. In one specific embodiment, said combination may be obtained by crossing transgenic plants of the present disclosure each bearing one nucleic acid of the combination as a transgene at a distinct locus.

Typically, said transgenic or genetically engineered plant includes the following combination of nucleic acids as transgenic or genetically engineered elements:

a. a Rf1 nucleic acid, preferably encoding an amino acid sequence having at least 95% identity or at least 96% identity with any one of SEQ ID NOs 359, 361, 362 or SEQ ID NOs 428-430, preferably SEQ ID NO:361, typically a Rf1 nucleic acid comprises SEQ ID NO:3119, and Rf3 nucleic acid, preferably encoding an amino acid sequence having at least 95% identity or at least 96% identity with any one of SEQ ID NOs: 315-321, SEQ ID NOs: 379-381, SEQ ID NOs: 147 and 150, SEQ ID NOs: 156 and 158, SEQ ID NOs 297 and 299, SEQ ID NO:676 and SEQ ID NO:684, b. a Rf1 nucleic acid, preferably encoding an amino acid sequence having at least 95% identity or at least 96% identity with any one of SEQ ID NOs 359, 361, 362 or SEQ ID NOs 428-430, preferably SEQ ID NO:361, typically a Rf1 nucleic acid comprises SEQ ID NO:3119, and Rf7 nucleic acid, preferably encoding an amino acid sequence having at least 95% identity or at least 96% identity with any one of SEQ ID NO:363, SEQ ID NO: 516 and SEQ ID NO:768, c. a Rf1 nucleic acid, preferably encoding an amino acid sequence having at least 95% identity or at least 96% identity with any one of SEQ ID NOs 359, 361, 362 or SEQ ID NOs 428-430, preferably SEQ ID NO:361, typically a Rf1 nucleic acid comprises SEQ ID NO:3119, and Rf-rye nucleic acid, preferably encoding an amino acid sequence having at least 95% identity or at least 96% identity, with any one of SEQ ID NO: 227, SEQ ID NO:378 and SEQ ID NO:859, d. a Rf3 nucleic acid, preferably encoding an amino acid sequence having at least 95% identity or at least 96% identity with any one of SEQ ID NOs: 315-321, SEQ ID NOs: 379-381, SEQ ID NOs: 147 and 150, SEQ ID NOs: 156 and 158, SEQ ID NOs 297 and 299, SEQ ID NO:676 and SEQ ID NO:684, and Rf7 nucleic acid, preferably encoding an amino acid sequence having at least 95% identity or at least 96% identity with SEQ ID NO:363, SEQ ID NO:516 and SEQ ID NO:768, e. a Rf3 nucleic acid, preferably encoding an amino acid sequence having at least 95% identity or at least 96% identity with any one of SEQ ID NOs: 315-321, SEQ ID NOs: 379-381, SEQ ID NOs: 147 and 150, SEQ ID NOs: 156 and 158, SEQ ID NOs 297 and 299, SEQ ID NO:676 and SEQ ID NO:684, and Rf-rye nucleic acid, preferably encoding an amino acid sequence having at least 95% identity or at least 96% identity with any one of SEQ ID NO:227, SEQ ID NO:378 and SEQ ID NO:859, f. a Rf7 nucleic acid, preferably encoding an amino acid sequence having at least 95% identity or at least 96% identity with SEQ ID NO:363, SEQ ID NO: 516 and SEQ ID NO:768, and Rf-rye nucleic acid, preferably encoding an amino acid sequence having at least 95% identity or at least 96% identity with any one of SEQ ID NO:227, SEQ ID NO:378 and SEQ ID NO:859, g. a Rf1 nucleic acid, preferably encoding an amino acid sequence having at least 95% identity or at least 96% identity with any one of SEQ ID NOs 359, 361, 362 or SEQ ID NOs 428-430, preferably SEQ ID NO:361, typically a Rf1 nucleic acid comprises SEQ ID NO:3119, and Rf3 nucleic acid, preferably encoding an amino acid sequence having at least 95% identity or at least 96% identity with any one of SEQ ID NOs: 315-321, SEQ ID NOs: 379-381, SEQ ID NOs: 147 and 150, SEQ ID NOs: 156 and 158, SEQ ID NOs 297 and 299, SEQ ID NO:676 and SEQ ID NO: 684, and Rf7 nucleic acid, preferably encoding an amino acid sequence having at least 95% identity or at least 96% identity with any one of SEQ ID NO:363, SEQ ID NO:516 and SEQ ID NO:768;

h. a Rf1 nucleic acid, preferably encoding an amino acid sequence having at least 95% identity or at least 96% identity with any one of SEQ ID NOs 359, 361, 362 or SEQ ID NOs 428-430, preferably SEQ ID NO:361, typically a Rf1 nucleic acid comprises SEQ ID NO:3119, and Rf3 nucleic acid, preferably encoding an amino acid sequence having at least 95% identity or at least 96% identity with any one of SEQ ID NOs: 315-321, SEQ ID NOs: 379-381, SEQ ID NOs: 147 and 150, SEQ ID NOs: 156 and 158, SEQ ID NOs 297 and 299, SEQ ID NO:676 and SEQ ID NO: 684, and Rf-rye nucleic acid, preferably encoding an amino acid sequence having at least 95% identity, or at least 96% identity, with any one of SEQ ID NO:227, SEQ ID NO:378 and SEQ ID NO:859;

i. a Rf1 nucleic acid, preferably encoding an amino acid sequence having at least 95% identity, for example at least 96% identity with any one of SEQ ID NOs 359, 361, 362 or SEQ ID NOs 428-430, preferably SEQ ID NO: 361, typically a Rf1 nucleic acid comprises SEQ ID NO:3119, and Rf7 nucleic acid of claim 4, preferably encoding an amino acid sequence having at least 95% identity or at least 96% identity with any one of SEQ ID NO:363, SEQ ID NO:516 and SEQ ID NO:768, and Rf-rye nucleic acid, preferably encoding an amino acid sequence having at least 95% identity or at least 96% identity, with any one of SEQ ID NO: 227, SEQ ID NO:378 and SEQ ID NO:859; or, j. a Rf3 nucleic acid, preferably encoding an amino acid sequence having at least 95% identity or at least 96% identity with any one of SEQ ID NOs: 315-321, SEQ ID NOs: 379-381, SEQ ID NOs: 147 and 150, SEQ ID NOs: 156 and 158, SEQ ID NOs 297 and 299, SEQ ID NO:676 and SEQ ID NO:684, and Rf7 nucleic acid, preferably encoding an amino acid sequence having at least 95% identity or at least 96% identity with any one of SEQ ID NO:363, SEQ ID NO:516 and SEQ ID NO:768, and Rf-rye nucleic acid, preferably preferably encoding an amino acid sequence having at least 95% identity or at least 96% identity with any one of SEQ ID NO:227, SEQ ID NO:378 and SEQ ID NO:859.

In other specific embodiments, said transgenic or genetically engineered plant further includes a Rf4 nucleic acid encoding an amino acid sequence having at least 95% identity to any one of SEQ ID NOs: 477, and SEQ ID NOs 3135-3138 in addition to any one of the above defined combination of Rf1, Rf3, Rf7 and/or Rf-Rye nucleic acids as defined in the previous paragraph, as transgenic elements.

The disclosure also relates to hybrid wheat plants which can be produced by crossing a transgenic or genetically engineered wheat plant restorer of fertility according to the present disclosure as described above with a second plant.

In certain embodiments, the wheat plant according to the disclosure is alloplasmic and comprises the *T. timopheevii* cytoplasm.

For example, a hybrid wheat plant may be obtained by crossing a wheat plant restorer of fertility according to the present disclosure as described above, preferably comprising Rf1, Rf3, Rf4, Rf7 or Rf-rye nucleic acids, and a wheat plant which does not express corresponding Rf1, Rf3, Rf4, Rf7 or Rf-rye protein restorer of fertility.

It is also disclosed herein a method for producing a wheat hybrid transgenic or genetically engineered plant comprising the steps of:
a. crossing a sterile female wheat plant comprising the *T. timopheevii* cytoplasm with a fertile male transgenic or genetically engineered wheat plant restorer of fertility of the present disclosure as described above;
b. collecting the hybrid seed;
c. optionally detecting the presence of *T. timopheevii* cytoplasm, and/or at least one or more of the Rf nucleic acids chosen amongst Rf1, Rf3, Rf4, Rf7 and Rf-rye in the hybrid seed, as transgenic elements or genetically engineered elements; and,
d. optionally detecting hybridity level of the hybrid seed.

Therefore, it is also disclosed herein the wheat transgenic or genetically engineered plants or lines according to the present disclosure developed to obtain such hybrid plants. Such transgenic or genetically engineered plants or lines typically comprise the cytoplasmic elements necessary for the implementation of the corresponding hybrid system. Preferably, the transgenic or genetically engineered plants or lines comprise a combination of at least two, three or four of Rf1, Rf3, Rf4, Rf7 and Rf-rye nucleic acids, and *T. timopheevii* cytoplasm.

Alternatively, the detection of the presence of *T. timopheevii* cytoplasm and of at least one or more of the Rf nucleic acids chosen amongst Rf1, Rf3, Rf4, Rf7 and Rf-rye (step "c" of the method described above) can be performed on the parent lines in order to check their genotype before to start the cross (step "a").

In a certain embodiment of the disclosure, the male wheat plant is taller than the female wheat plant. This can be achieved by using male plant bearing Rht alleles that allows to obtain the size differences. Optionally, the disclosure further comprises the step of to applying an herbicide to the fertile plants standing above the height of the shorter female plants, and further optionally, comprises the step of harvesting the seeds and selecting the seeds to remove undesirable self-fertilized male seeds, using a morphological character and/or a phenotypic character like size, shape, color etc. . . . An example of such method for hybrid production is described in WO2015135940.

The T-CMS cytoplasm can be detected either phenotypically wherein a plant bearing rf genes and a T-CMS cytoplasm will be sterile or by molecular means able to detect the orf256 gene as described in Rathbun and Hedgcoth, 1991 and Song and Hedgcoth, 1994.

The disclosure also relates to a method for improving the level of fertility restoration of a parent wheat plant bearing a fertility level lower than a full restoration level, comprising the steps of transforming said parent wheat plant with a vector comprising a Rf1, Rf3, Rf4, Rf7 and/or Rf-rye nucleic acid as described above, or genetically engineering said Rf1, Rf3, Rf4, Rf7 and/or Rf-rye nucleic acids in said wheat plant. The method further comprises the step of selecting a transgenic or genetically engineered wheat plant comprising said Rf1, Rf3, Rf4, Rf7 and/or Rf-rye nucleic acid(s) as a transgene or genetically engineered element, preferably Rf1, Rf3 and Rf4, regenerating and growing said transgenic or genetically engineered wheat plant, wherein said transgenic or genetically engineered wheat plant has an improved fertility restoration level as compared to the parent plant.

The disclosure further provides a method for restoring fertility of a sterile wheat plant bearing the *T. timopheevii* CMS cytoplasm, comprising the step of transforming a parent sterile wheat plant bearing the *T. timopheevii* CMS cytoplasm, with a Rf1, Rf3, Rf4, Rf7 and/or Rf-rye nucleic acid as described above or genetically engineering said sterile plant to express a Rf1, Rf3, Rf4, Rf7 and/or Rf-rye nucleic acids.

Use of the Nucleic Acids of the Present Disclosure for Identifying Rf1, Rf3, Rf4, Rf7 and Rf-Rye Restorer Alleles or Transgenic Elements The present disclosure further provides methods of identifying the respective Rf1, Rf3, Rf4, Rf7 and/or Rf-rye restorer alleles and/or Rf1, Rf3, Rf4, Rf7 and/or Rf-rye nucleic acids as disclosed in the previous sections, and more generally methods of selecting or breeding wheat plants for the presence or absence of the Rf1, Rf3, Rf4, Rf7 and/or Rf-rye fertility restorer alleles and/or corresponding Rf1, Rf3, Rf4, Rf7 and/or Rf-rye nucleic acids.

Such methods of identifying, selecting or breeding wheat plants comprise obtaining one or more wheat plants and assessing their DNA to determine the presence or absence of the Rf1, Rf3, Rf4, Rf7 and/or Rf-rye fertility restorer alleles and/or corresponding Rf1, Rf3, Rf4, Rf7 and/or Rf-rye nucleic acids.

Such methods may be used, for example, to determine which progeny resulting from a cross have the required fertility restorer allele or Rf nucleic acids (or combination thereof) and accordingly to guide the preparation of plants having the required fertility restorer allele or Rf nucleic acids in combination with the presence or absence of other desirable traits.

The method will consist of identifying the presence of the Rf1, Rf3, Rf4, Rf7 and/or Rf-rye allele or nucleic acids in the fertile plant, said plant being either a fertile transgenic plant or a non-transgenic plant. Optionally, the method further consists of identifying the absence of the Rf1, Rf3, Rf4, Rf7 and/or Rf-rye allele or nucleic acids in non-restorer plants and/or sterile plants.

Accordingly, it is disclosed herein the means for specifically detecting the Rf1, Rf3, Rf4, Rf7 and/or Rf-rye nucleic acids in a wheat plant.

Such means include for example a pair of primers for the specific amplification of a fragment nucleotide sequence of Rf1, Rf3, Rf4, Rf7 and/or Rf-rye nucleic acids from plant wheat genomic DNA.

As used herein, a primer encompasses any nucleic acid that is capable of priming the synthesis of a nascent nucleic acid in a template-dependent process, such as PCR. Typically, primers are oligonucleotides from 10 to 30 nucleotides, but longer sequences can be employed. Primers may be provided in double-stranded form though single-stranded form is preferred.

Alternatively, nucleic acid probe can be used for the specific detection of any one of Rf1, Rf3, Rf4, Rf7 and/or Rf-rye nucleic acids.

As used herein, a nucleic acid probe encompass any nucleic acid of at least 30 nucleotides and which can specifically hybridizes under standard stringent conditions with a defined nucleic acid. Standard stringent conditions as used herein refers to conditions for hybridization described for example in Sambrook et al 1989 which can comprise 1) immobilizing plant genomic DNA fragments or library DNA on a filter 2) prehybridizing the filter for 1 to 2 hours at 65° C. in 6×SSC 5×Denhardt's reagent, 0.5% SDS and 20 mg/ml denatured carrier DNA 3) adding the probe (labeled) 4) incubating for 16 to 24 hours 5) washing the filter once for 30 min at 68° C. in 6×SSC, 0.1% SDS 6) washing the filter three times (two times for 30 min in 30 ml and once for 10 min in 500 ml) at 68° C. in 2×SSC 0.1% SDS. The nucleic acid probe may further comprise labeling agent, such as fluorescent agents covalently attached to the nucleic acid part of the probe.

Methods of Producing a Wheat Plant Carrying a Modified Rf3 Restorer of Fertility The inventors have also identified two types of Rf3 restorer of fertility, one with a strong fertility restoration, for example, capable of providing plants with a fertility score above 1.0, for example comprised between 1.0 and 2.0 and another with a weak fertility restoration, for example, capable of providing plants having a fertility score below 0.1, for example comprised between between 0.5 and 1.0.

Surprisingly, the strong fertility restoration correlates with the absence in the genome of the wheat plant carrying Rf3 of a 163 bp fragment of SEQ ID NO:3174, located in the 5'UTR of Rf3 coding sequence.

Accordingly, the disclosure relates to a method for producing a wheat plant carrying a Rf3 restorer of fertility, said method comprising (i) providing a parent wheat plant comprising in its genome at least a 163 bp fragment of SEQ ID NO:3174, and (ii) deleting a fragment of at least 10 bp of said fragment of SEQ ID NO:3174, for example at least 20 bp, 30 bp, 40 bp, 50 bp, 60 bp, 70 bp, 80 bp, 90 bp, 100 bp, 110 bp, 120 bp, 130 bp, 140 bp, 150 bp, 160 bp or the whole fragment of SEQ ID NO:3174 in the genome of said wheat plant, thereby obtaining said wheat plant carrying a Rf3 restorer of fertility.

Advantageously, the fertility score of the obtained wheat plant has a fertility score higher than the parent wheat plant, due to the deletion of said fragment depicted in SEQ ID NO:3174. The skilled person may select the deletion such as to obtain an increase in fertility restoration as compared to the parent wheat plant with the full fragment of SEQ ID NO:3174 in its genome.

In specific embodiments, the parent wheat plant has a fertility score below 1, for example comprised between 0.5 and 1.0 and the obtained wheat plant has a fertility score above 1.0, for example comprised between 1.0 and 2.0.

It is also possible to restore fertility from plants having rf3 non-restorer allele presenting a frameshift due to nucleotides deletion or insertion as compared to the Rf3 restorer allele RLF29a sequence of SEQ ID NO:3146 (see also Example 22).

Such deletion of genomic fragment or correction of frameshift may be obtained by any suitable methods known by the skilled person in the art, including genome editing tools such as, but not limited to, meganucleases, ZFNs, TALENs (WO2011072246) or CRISPR CAS system (including CRISPR Cas9, WO2013181440) or their next generations based on double-strand break technologies using engineered nucleases. Examples of such methods are also described in Example 15 and Example 22.

The wheat plants as obtained by the method described above are also part of the disclosure. Typically, such wheat plant as obtained by the above method, or obtainable by such method, carries a Rf3 restorer of fertility, wherein only a part but not the whole genomic fragment of SEQ ID NO:3174 is deleted in the genome of said wheat plant. Typically, a fragment between 10 bp and 162 bp of SEQ ID NO:3174 is deleted in the genome of said wheat plant. It is expected that the obtained wheat plant with the genome deletion has a fertility score higher than the fertility score as measured in a parent wheat plant with identical genome except for the full sequence of SEQ ID NO: 3174 in its genome. Alternatively, such wheat plant as obtained by the above method, or obtainable by such method, carries a Rf3 restorer of fertility, wherein nucleotides of RFL29c has been deleted or added to restore inframe translation.

Methods for Assessing Fertility Restoration in a Wheat Plant

The disclosure also includes a method for assessing fertility restoration in a wheat plant, said method comprising determining the presence or absence of a fragment of SEQ ID NO:3174 in the genome of said plant, wherein the presence of the whole fragment is indicative of a weak restoration of fertility and a deletion of at least a part of such fragment is indicative of a strong restoration of fertility. Typically said method is performed in a wheat plant which is susceptible to carry a Rf3 restorer of fertility.

It is also disclosed herein nucleic acid probes for use in the above methods for assessing fertility restoration in wheat plant, wherein said nucleic acid probe consists of a nucleic acid of at least 10 nucleotides within SEQ ID NO:3174.

Typically, said nucleic acid probe is a fragment of at least 20 bp, 30 bp, 40 bp, 50 bp, 60 bp, 70 bp, 80 bp, 90 bp, 100 bp, 110 bp, 120 bp, 130 bp, 140 bp, 150 bp, 160 bp or the whole fragment of SEQ ID NO: 3174.

The Wheat Plant Restorer of Fertility of T. timopheevii CMS Cytoplasm with at Least Three Specific Fertility Restorer Alleles The inventors have shown that a combination of at least 3 specific fertility restorer alleles within the restorer loci Rf1, Rf3, Rf4 and Rf7 enable the obtention of plants with full restoration of fertility of T. timopheevii CMS cytoplasm.

Therefore, a first aspect of the present disclosure relates to a wheat plant restorer of fertility of T. timopheevii CMS cytoplasm, wherein the plant comprises at least three fertility restorer alleles within the restorer loci chosen amongst Rf1, Rf3, Rf4 and Rf7.

In specific embodiments, the plant comprises at least the three fertility restorer alleles Rf1, Rf3, Rf4.

In specific embodiments, the plant comprises at least the three fertility restorer alleles Rf1, Rf4, Rf7.

In specific embodiments, the plant comprises at least the three fertility restorer alleles Rf1, Rf3, Rf7.

In specific embodiments, the plant comprises at least the three fertility restorer alleles Rf3, Rf4, Rf7.

As used herein, the Rf1 locus refers to the locus of the Rf1 restorer allele, which locus is located at most 10 cM, preferably at most 7 cM, more preferably at most 2 cM, from marker cfn0522096 of SEQ ID NO:4 and/or from marker cfn05277067 of SEQ ID NO: 10. In a specific embodiment, the wheat plant restorer of fertility according to the present disclosure includes at least one Rf1 restorer allele, said Rf1 restorer allele being located within the chromosomal interval between SNP markers cfn0522096 of SEQ ID NO:3190 and cfn05277067 of SEQ ID NO:3196. In specific embodiments, the wheat plant restorer of fertility includes one Rf1 restorer allele at the Rf1 locus characterized by the presence of one or more of the SNP allele(s) as identified by Table 1.

TABLE 1

SNP markers for mapping of Rf1 locus

| SNP# | Marker Name | Marker SEQ ID NO: | Restorer Allele |
|---|---|---|---|
| SNP1 | cfn523072 | 3187 | T |
| SNP2 | cfn0523109 | 3188 | A |
| SNP3 | 276I13_96B22_97797 | 3189 | C |
| SNP4 | cfn0522096 | 3190 | C |
| SNP5 | cfn0527763 | 3191 | C |
| SNP6 | 104A4_105172 | 3192 | TG |

TABLE 1-continued

SNP markers for mapping of Rf1 locus

| SNP# | Marker Name | Marker SEQ ID NO: | Restorer Allele |
|---|---|---|---|
| SNP7 | 104A4__105588 | 3193 | A |
| SNP8 | cfn0373248 | 3194 | T |
| SNP9 | cfn1097828 | 3195 | C |
| SNP10 | cfn0527067 | 3196 | A |
| SNP11 | cfn0528390 | 3197 | G |
| SNP12 | BWS0267 | 3198 | A |
| SNP13 | cfn0527718 | 3199 | T |
| SNP14 | cfn0524469 | 3200 | G |
| SNP15 | cfn0524921 | 3201 | G |
| SNP16 | cfn1122326 | 3202 | C |

Preferably, the wheat plant restorer of fertility according to the present disclosure includes one Rf1 restorer allele at the Rf1 locus characterized by the presence of the SNP3 and/or SNP7 restorer alleles(s) as described in Table 1. More preferably, the wheat plant restorer of fertility is characterized by the haplotypes of the SNP3 and SNP7 restorer alleles "C" and "A". In specific embodiments, the wheat plant restorer of fertility with Rf1 restorer allele comprises a Rf1 nucleic acid of the present disclosure as described above. Examples of Rf1 nucleic acids comprises the disclosed Rf1 nucleic acid sequences of SEQ ID NO: 1913, SEQ ID NO: 1914, SEQ ID NO: 1915, SEQ ID NO: 1916 or SEQ ID NO:3119, preferably a Rf1 nucleic acid comprises SEQ ID NO: 3119.

As used herein, the Rf3 locus refers to the locus of the Rf3 restorer allele, which locus is at most 10 cM, preferably at most 7 cM, more preferably at most 2 cM, from marker cfn1249269 of SEQ ID NO:3205 and/or from marker BS00090770 of SEQ ID NO:3228. In a specific embodiment, the wheat plant restorer of fertility includes at least one Rf3 restorer allele within the Rf3 locus, said Rf3 restorer allele being located within the chromosomal fragment between SNP markers cfn1249269 and BS00090770. In specific embodiment, the wheat plant restorer of fertility includes one Rf3 restorer allele at the Rf3 locus characterized by the presence of one or more of the SNP alleles(s) as identified by Table 2.

TABLE 2

SNP Markers for mapping of Rf3 locus

| SNP# | Marker Name | Marker SEQ ID | Restorer Allele |
|---|---|---|---|
| SNP17 | cfn1252000 | 3203 | A |
| SNP18 | IWB14060* | 3204 | G |
| SNP19 | cfn1249269 | 3205 | G |
| SNP20 | 219K1__166464 | 3206 | T |
| SNP21 | 219K1__158251 | 3207 | G |
| SNP22 | 219K1__111446 | 3208 | A |
| SNP23 | 219K1__110042 | 3209 | T |
| SNP24 | 219K1__110005 | 3210 | C |
| SNP25 | 219K1__107461 | 3211 | A |
| SNP26 | 219K1__99688 | 3212 | T |
| SNP27 | 219K1__37 | 3213 | C |
| SNP28 | cfn1270524 | 3214 | T |
| SNP29 | 136H5__3M5__7601 | 3215 | T |
| SNP30 | cfn1288811 | 3216 | G |
| SNP31 | 136H5__3M5__89176 | 3217 | A |
| SNP32 | 136H5__3M5__89263 | 3218 | T |
| SNP33 | 136H5__3M5__138211 | 3219 | T |
| SNP34 | cfn0556874 | 3220 | C |
| SNP35 | 136H5__3M5__64154 | 3221 | C |
| SNP36 | 136H5__3M5__68807 | 3222 | G |
| SNP37 | 136H5__3M5__77916 | 3223 | A |
| SNP38 | cfn1246088 | 3224 | A |

TABLE 2-continued

SNP Markers for mapping of Rf3 locus

| SNP# | Marker Name | Marker SEQ ID | Restorer Allele |
|---|---|---|---|
| SNP39 | cfn1287194 | 3225 | G |
| SNP40 | cfn1258380 | 3226 | A |
| SNP41 | IWB72107* | 3227 | A |
| SNP42 | BS00090770 | 3228 | T |
| SNP43 | cfn1239345 | 3229 | A |

Preferably, the wheat plant restorer of fertility according to the present disclosure includes one Rf3 restorer allele at the Rf3 locus characterized by the presence of the SNP29 and/or SNP31 restorer alleles(s) as described in Table 2. More preferably, the wheat plant restorer of fertility is characterized by the haplotype of the SNP29 and SNP31 restorer alleles "T" and "A" respectively.

In another particular embodiment, that may be combined with the previous embodiments, the wheat plant restorer of fertility according to the present disclosure includes one Rf3 restorer allele at the Rf3 locus characterized by the presence of the SNP38 and SNP41 restorer alleles "A" and "A" respectively.

Preferably, the wheat plant restorer of fertility according to the present disclosure includes a Rf3 nucleic acid comprising SEQ ID NO:1712, SEQ ID NO:2230, SEQ ID NO:2238, SEQ ID NO:3146, SEQ ID NO:3147 or SEQ ID NO:3148, preferably SEQ ID NO: 3146.

As used herein, the Rf7 locus is located at most 10 cM from marker cfn0919993 of SEQ ID NO:3231. In specific embodiment, the wheat plant restorer of fertility includes one Rf7 restorer allele at the Rf7 locus characterized by the presence of one or more of the SNP alleles(s) as identified by Table 3:

TABLE 3

SNP markers of Rf7 locus

| SNP# | Marker Name | Marker SEQ ID | Restorer Allele |
|---|---|---|---|
| SNP44 | cfn0917304 | 3230 | T |
| SNP45 | cfn0919993 | 3231 | G |
| SNP46 | cfn0920459 | 3232 | C |
| SNP49 | cfn0915987 | 3445 | G |
| SNP50 | cfn0920253 | 3446 | A |
| SNP51 | cfn0448874 | 3447 | T |
| SNP52 | cfn0923814 | 3448 | C |
| SNP53 | cfn0924180 | 3449 | G |
| SNP54 | cfn0919484 | 3450 | G |

Preferably, the wheat plant restorer of fertility according to the present disclosure includes one Rf7 restorer allele at the Rf7 locus characterized by the presence of the nine SNP restorer alleles SNP44-SNP46 and SNP49-54 of "restorer allele" haplotype, as described in Table 3.

As used herein, the Rf4 locus is located at most 10 cM from marker cfn0393953 of SEQ ID NO:3233. In specific embodiment, the wheat plant restorer of fertility includes one Rf4 restorer allele at the Rf4 locus characterized by the presence of one or more of the SNP alleles(s) as identified by Table 4.

TABLE 4

SNP markers of Rf4 locus

| SNP# | Marker Name | Marker SEQ ID | Restorer Allele |
|---|---|---|---|
| SNP47 | cfn0393953 | 3233 | C |
| SNP48 | cfn0856945 | 3234 | G |

Preferably, the wheat plant restorer of fertility according to the present disclosure includes one Rf4 restorer allele at the Rf4 locus characterized by the presence of the two SNP restorer alleles, SNP47, and SNP48, of the haplotype "C" and "G" respectively, as described in Table 4.

In specific embodiments, the wheat plant restorer of fertility with Rf4 restorer allele comprises a Rf4 nucleic acid of the present disclosure as described above. Examples of Rf4 nucleic acids comprises the disclosed Rf4 nucleic acid sequences of SEQ ID NO: 2031, SEQ ID NO:3140 to 3142.

In a particular embodiment, the wheat plant restorer of fertility of *T. timopheevii* CMS cytoplasm comprises one Rf3 restorer allele and two other fertility restorer alleles selected amongst Rf1, Rf4 and Rf7 restorer alleles. Preferably, the wheat plant restorer of fertility of *T. timopheevii* CMS cytoplasm according to the present disclosure comprises the Rf1, Rf3, and Rf7 restorer alleles.

In particular, it is hereby included a wheat plant comprising Rf1, Rf3 and Rf7 restorer alleles as provided by the seed samples as deposited on 25 Sep. 2017 under deposit number NCIMB 42811, NCIMB 42812, NCIMB 42813, NCIMB 42814, NCIMB 42815, NCIMB 42816, and NCIMB 42817 at the NCIMB collection. The NCIMB is located at Ferguson Building, Craibstone Estate, Bucksburn, Aberdeen, Scotland, UK, AB21 9YA.

The disclosure also relates to hybrid wheat plants which can be produced by crossing a wheat plant restorer of fertility according to the present disclosure as described above with a second plant.

In certain embodiments, the wheat plant according to the disclosure is alloplasmic and comprises the *T. timopheevii* cytoplasm.

For example, a hybrid wheat plant may be obtained by crossing a wheat plant restorer of fertility according to the present disclosure as described above, preferably comprising Rf1, Rf3 and Rf7 restorer alleles, and a wheat plant which does not have said fertility restorer alleles.

It is also disclosed herein a method for producing a wheat hybrid plant comprising the steps of:
a. crossing a sterile female wheat plant comprising the *T. timopheevii* cytoplasm with a fertile male wheat plant of the present disclosure as described above;
b. collecting the hybrid seed;
c. optionally detecting the presence of *T. timopheevii* cytoplasm, and/or at least three of the Rf locus chosen amongst Rf1, Rf3, Rf4 and Rf7 in the hybrid seed;
d. optionally detecting hybridity level of the hybrid seed.

Therefore, it is also disclosed herein the wheat plants or lines according to the present disclosure developed to obtain such hybrid plants. Such plants or lines typically comprise the cytoplasmic elements necessary for the implementation of the corresponding hybrid system. Preferably, the plants or lines comprise the fertility restorer alleles Rf1, Rf3 and Rf7 and *T. timopheevii* cytoplasm. In specific embodiments, such plants or lines comprise a fertility restorer allele Rf1 comprising a Rf1 nucleic acid of the present disclosure as disclosed above.

Alternatively, the detection of the presence of *T. timopheevii* cytoplasm and of at least three of the Rf locus chosen amongst Rf1, Rf3, Rf4 and Rf7 (step "c" of the method described above) can be performed on the parent lines in order to check their genotype before to start the cross (step "a").

The T-CMS cytoplasm can be detected either phenotypically wherein a plant bearing rf genes and a T-CMS cytoplasm will be sterile or by molecular means able to detect the orf256 gene as described in Rathburn and Hedgcoth, 1991 and Song and Hedgcoth, 1994.

Method of Producing and Selecting a Wheat Plant of the Disclosure

The present disclosure also relates to the methods to produce the wheat plant with the fertility restorer alleles as described in the previous section.

In one embodiment, said method for producing the wheat plant includes the following step:
a. providing a first wheat plant comprising one or two restorer allele selected among Rf1, Rf3 and Rf7 restorer alleles,
b. crossing said first wheat plant with a second wheat plant comprising one or two restorer alleles selected among Rf1, Rf3 and Rf7 restorer alleles, wherein Rf1, Rf3 and Rf7 restorer alleles are represented at least once in the panel of restorer alleles provided by the first plant and the second plant,
c. collecting the F1 hybrid seed,
d. obtaining homozygous plants from the F1 plants,
e. optionally detecting the presence of the Rf1, Rf3 and Rf7 restorer alleles in the hybrid seed and/or at each generation.

Preferentially, the female plant in step b) is bearing the T-CMS cytoplasm. In this case, the presence of the restorer alleles is assessed at every generation from step b) to step d) by using the markers and optionally by further by assessing the fertility level.

Method to generate homozygous plants are generally well known from skilled person of the art. This could be either by repetitive backcross or by double haploid development or by Single Seeds Descent (SSD) methods.

The applicant has deposited a sample of seeds of the disclosed wheat plant with said Rf1, Rf3 and Rf7 restorer alleles, on 25 Sep. 2017 under the Budapest treaty, at NCIMB collection under the number NCIMB 42811, NCIMB 42812, NCIMB 42813, NCIMB 42814, NCIMB 42815, NCIMB 42816, and NCIMB 42817. The NCIMB is located at Ferguson Building, Craibstone Estate, Bucksburn, Aberdeen, Scotland, UK, AB21 9YA.

The present disclosure further includes and provides methods of identifying the respective Rf1, Rf3, Rf4 and/or Rf7 restorer alleles as disclosed in the previous sections, and more generally methods of selecting or breeding wheat plants for the presence or absence of the Rf1, Rf3, Rf4 and/or Rf7 fertility restorer alleles. Such methods of identifying, selecting or breeding wheat plants comprise obtaining one or more wheat plants and assessing their DNA to determine the presence or absence of the Rf1, Rf3, Rf4 and/or Rf7 fertility restorer alleles contained in the respective locus.

Such methods may be used, for example, to determine which progeny resulting from a cross have the required combination of fertility restorer alleles and accordingly to guide the preparation of plants having the required combination in combination with the presence or absence of other desirable traits.

Accordingly, plants can be identified or selected by assessing them for the presence of one or more individual SNPs appearing in the above Tables 1, 2, 3 and 4, as well as the SNPs in Table 19, for assessing the presence of restorer alleles Rf1, Rf3, Rf7 or Rf4 respectively.

More generally, it is disclosed herein the specific means for detecting the restorer alleles in a wheat plant, more specifically Rf1, Rf3, Rf4 and Rf7 restorer alleles and their combinations.

Said means thus include any means suitable for detecting the following SNP markers within one or more of the following markers: SEQ ID NOs 3187-3235.

Any method known in the art may be used in the art to assess the presence or absence of a SNP. Some suitable methods include, but are not limited to, sequencing, hybridization assays, polymerase chain reaction (PCR), ligase chain reaction (LCR), and genotyping-by-sequence (GBS), or combinations thereof.

Different PCR based methods are available to the person skilled of the art. One can use the RT-PCR method or the Kaspar method from KBioscience (LGC Group, Teddington, Middlesex, UK).

The KASP™ genotyping system uses three target specific primers: two primers, each of them being specific of each allelic form of the SNP (Single Nucleotide Polymorphism) and one other primer to achieve reverse amplification, which is shared by both allelic form. Each target specific primer also presents a tail sequence that corresponds with one of two FRET probes: one label with FAM® dye and the other with HEX® dye.

Successive PCR reactions are performed. The nature of the emitted fluorescence is used to identify the allelic form or forms present in the mix from the studied DNA.

The primers identified in Table 5 are particularly suitable for use with the KASP™ genotyping system. Of course, the skilled person may use variant primers or nucleic acid probes of the primers as identified in Table 5, said variant primers or nucleic acid probes having at least 90%, and preferably 95% sequence identity with any one of the primers as identified in Table 5, or with the DNA genomic fragment amplified by the corresponding set of primers as identified in Table 5.

Percentage of sequence identity as used herein is determined by calculating the number of matched positions in aligned nucleic acid sequences, dividing the number of matched positions by the total number of aligned nucleotides, and multiplying by 100. A matched position refers to a position in which identical nucleotides occur at the same position in aligned nucleic acid sequences. For example, nucleic acid sequences may be aligned using the BLAST 2 sequences (Bl2seq) using BLASTN algorithms (www.ncbi.nlm.nih.gov).

As used herein, a primer encompasses any nucleic acid that is capable of priming the synthesis of a nascent nucleic acid in a template-dependent process, such as PCR. Typically, primers are oligonucleotides from 10 to 30 nucleotides, but longer sequences can be employed. Primers may be provided in double-stranded form though single-stranded form is preferred. Alternatively, nucleic acid probe can be used. Nucleic acid probe encompass any nucleic acid of at least 30 nucleotides and which can specifically hybridizes under standard stringent conditions with a defined nucleic acid. Standard stringent conditions as used herein refers to conditions for hybridization described for example in Sambrook et al 1989 which can comprise 1) immobilizing plant genomic DNA fragments or library DNA on a filter 2) prehybridizing the filter for 1 to 2 hours at 65° C. in 6×SSC 5×Denhardt's reagent, 0.5% SDS and 20 mg/ml denatured carrier DNA 3) adding the probe (labeled) 4) incubating for 16 to 24 hours 5) washing the filter once for 30 min at 68° C. in 6×SSC, 0.1% SDS 6) washing the filter three times (two times for 30 min in 30 ml and once for 10 min in 500 ml) at 68° C. in 2×SSC 0.1% SDS.

In specific embodiments, said primers for detecting the SNP markers of the present disclosure (specific for each allele "X" or "Y" or common) are as listed in the following table 5:

TABLE 5

Primers for use in detecting fertility restorer SNP markers of the invention (as indicated in the primer name)

| SEQ ID NO | ID | | Sequence |
|---|---|---|---|
| 3253 | cfn0238384 | AlleleX | GAAGGTGACCAAGTTCATGCTGTAAAAAGATGTCTGTGTGTCTAGC |
| 3254 | cfn0523109 | AlleleX | GAAGGTGACCAAGTTCATGCTGGTGAACAAAACAGGCCTACAATCA |
| 3255 | cfn0560679 | AlleleX | GAAGGTGACCAAGTTCATGCTAATGATGTTTAACATTGGAACGGTCC |
| 3256 | cfn0917304 | AlleleX | GAAGGTGACCAAGTTCATGCTGTGGTGGCGCTCTACCCG |
| 3257 | cfn0919993 | AlleleX | GAAGGTGACCAAGTTCATGCTAAGTCATCGACTTACATGCTTCTTTG |
| 3258 | cfn0920459 | AlleleX | GAAGGTGACCAAGTTCATGCTAGCCAAGGAAGCCCAGATTTTC |
| 3259 | cfn1087371 | AlleleX | GAAGGTGACCAAGTTCATGCTAGGGGAACTTTGGGTATACACCA |
| 3260 | cfn1252000 | AlleleX | GAAGGTGACCAAGTTCATGCTGTTAATGCTGTAGCCATTCTTGCAA |

TABLE 5-continued

Primers for use in detecting fertility restorer SNP markers of the invention (as indicated in the primer name)

| SEQ ID NO | ID | Sequence |
|---|---|---|
| 3261 | BWS0267 AlleleX | GAAGGTGACCAAGTTCATGCTTCAGCTGCATAAA AAMCAGAATACCA |
| 3262 | cfn0524469 AlleleX | GAAGGTGACCAAGTTCATGCTGCACGTAGTAAGT ATTGATTTTTCTGTG |
| 3263 | cfn0527067 AlleleX | GAAGGTGACCAAGTTCATGCTCAAATTACTTTTGT TCTTTTATTTTTTCGAAT |
| 3264 | cfn0527718 AlleleX | GAAGGTGACCAAGTTCATGCTAATTGTTCACAACA TGGACATGAGAAC |
| 3265 | cfn1082074 AlleleX | GAAGGTGACCAAGTTCATGCTTACTGATAAAATCC GGTTCAAATATATAAC |
| 3266 | cfn1239345 AlleleX | GAAGGTGACCAAGTTCATGCTGGCTTCTTTTTTCT CCCTATAATATGGA |
| 3267 | cfn0554333 AlleleX | GAAGGTGACCAAGTTCATGCTGAGAGGCATCACA TAGGCATAG |
| 3268 | cfn0436720 AlleleX | GAAGGTGACCAAGTTCATGCTATTCTTCATTCCTT ACAACAAATATACCAAATT |
| 3269 | cfn0522096 AlleleX | GAAGGTGACCAAGTTCATGCTAGTAGAATACCAC CCAATAAATCACTG |
| 3270 | cfn0523072 AlleleX | GAAGGTGACCAAGTTCATGCTCTAGCGCATGAGG TCTATCG |
| 3271 | cfn0523990 AlleleX | GAAGGTGACCAAGTTCATGCTACATGAAGAGTGC AGGCACACG |
| 3272 | cfn0524921 AlleleX | GAAGGTGACCAAGTTCATGCTATTGTTTCCATGTT AAGCTTATATTGTGCA |
| 3273 | cfn0528390 AlleleX | GAAGGTGACCAAGTTCATGCTAAAAACATCTATTC CAAGCAAGTATTAGTAAT |
| 3274 | cfn0530841 AlleleX | GAAGGTGACCAAGTTCATGCTTCTTGTTTATATAT TCTCTTATCAGAAGTC |
| 3275 | cfn1122326 AlleleX | GAAGGTGACCAAGTTCATGCTGAATCTGATTAAGA CGCTGGAGAAC |
| 3276 | cfn1249269 AlleleX | GAAGGTGACCAAGTTCATGCTGATTCAAAGAGGT GACAAATATGTGTACT |
| 3277 | contig46312_253_ BS00090770 AlleleX | GAAGGTGACCAAGTTCATGCTGGTCGTAGCACAT AGCCGTTTAC |
| 3278 | 219K1_110042 AlleleX | GAAGGTGACCAAGTTCATGCTACGGAATCGAGTC AACCAATTCCT |
| 3279 | cfn0373248 AlleleX | GAAGGTGACCAAGTTCATGCTAACAACAATTAYGA GGATCAAATGGTCA |
| 3280 | cfn0527763 AlleleX | GAAGGTGACCAAGTTCATGCTATCTAGCCACGCA AATGCCCGT |
| 3281 | cfn0556874 AlleleX | GAAGGTGACCAAGTTCATGCTAAAGAGCATGTCA GACACAATGCAG |
| 3282 | cfn1097828 AlleleX | GAAGGTGACCAAGTTCATGCTGGTTCCTGAGAGA GCAACCA |
| 3283 | cfn1246088 AlleleX | GAAGGTGACCAAGTTCATGCTGACATCTGATGAG CCAGCATACA |
| 3284 | cfn1258380 AlleleX | GAAGGTGACCAAGTTCATGCTATCTACTCATCTAT TGCAGATGCTCTT |

TABLE 5-continued

Primers for use in detecting fertility restorer SNP markers of the invention (as indicated in the primer name)

| SEQ ID NO | ID | Sequence |
|---|---|---|
| 3285 | cfn1270524 AlleleX | GAAGGTGACCAAGTTCATGCTAAATGCCTAGTCTATACCTGATAAACTAAA |
| 3286 | cfn1287194 AlleleX | GAAGGTGACCAAGTTCATGCTACCTCCTCCGTATCTGATGGC |
| 3287 | cfn1288811 AlleleX | GAAGGTGACCAAGTTCATGCTTAATTTGGTTAACCAAATCCTTTTTGATTTTT |
| 3288 | cfn1291249 AlleleX | GAAGGTGACCAAGTTCATGCTTCCCAGATTTAGCATGTGCATT |
| 3289 | cfn0231871 AlleleX | GAAGGTGACCAAGTTCATGCTACTGTATTAAATTAGCTAGTGTGGCG |
| 3290 | cfn0393953 AlleleX | GAAGGTGACCAAGTTCATGCTAAAAACAAGTTGTCACCCAGATGAATC |
| 3291 | cfn0867742 AlleleX | GAAGGTGACCAAGTTCATGCTGCATCCTCGACAATGATTTCATCG |
| 3292 | cfn3126082 AlleleX | GAAGGTGACCAAGTTCATGCTAGATTTTAGCACCTAACGCCGCAAA |
| 3293 | 104A4_105172 AlleleX | GAAGGTGACCAAGTTCATGCTGTCGMACCCAATGAATAATGTTT |
| 3294 | 104A4_105588 AlleleX | GAAGGTGACCAAGTTCATGCTGTTCCTTGTGACATGTACTCATAA |
| 3295 | 136H5_3M5_138211 AlleleX | GAAGGTGACCAAGTTCATGCTACTGGGTGCAAAGCCAAGATGATT |
| 3296 | 136H5_3M5_64154 AlleleX | GAAGGTGACCAAGTTCATGCTGGCGAAACTTCGCCGCGATAAAT |
| 3297 | 136H5_3M5_68807 AlleleX | GAAGGTGACCAAGTTCATGCTCAAGTTGCTCTTAATTATCTGTGCGTA |
| 3298 | 136H5_3M5_7601 AlleleX | GAAGGTGACCAAGTTCATGCTCGTCCCCCATGGCACCTGT |
| 3299 | 136H5_3M5_77916 AlleleX | GAAGGTGACCAAGTTCATGCTATAGCAAGTAGAGTTAACTTATCAAGTTATTA |
| 3300 | 136H5_3M5_89176 AlleleX | GAAGGTGACCAAGTTCATGCTGGATTTTCTCACCGGCATCTCCA |
| 3301 | 136H5_3M5_89263 AlleleX | GAAGGTGACCAAGTTCATGCTTCCCATGTTCTTTTTTTGCTCAAAAC |
| 3302 | 219K1_107461 AlleleX | GAAGGTGACCAAGTTCATGCTATATTGTTTGTATTAAAAAGTTGTGTGTTTTGA |
| 3303 | 219K1_110005 AlleleX | GAAGGTGACCAAGTTCATGCTGCCTTTTCTTCTTCCAGCATCTAC |
| 3304 | 219K1_111446 AlleleX | GAAGGTGACCAAGTTCATGCTAGAATCGTTCTTCGAGAAGCACTCA |
| 3305 | 219K1_158251 AlleleX | GAAGGTGACCAAGTTCATGCTCCTGGAGATGGATCCGGTCAG |
| 3306 | 219K1_166464 AlleleX | GAAGGTGACCAAGTTCATGCTCCTGAGCTGGGCTGCACC |
| 3307 | 219K1_37 | GAAGGTGACCAAGTTCATGCTAAAGGGCTATCCTGGTGAACAAC |
| 3308 | 219K1_99688 AlleleX | GAAGGTGACCAAGTTCATGCTGTTGCCCTGCGCAAAATCAAACTT |

TABLE 5-continued

Primers for use in detecting fertility restorer SNP markers of the invention (as indicated in the primer name)

| SEQ ID NO | ID | Sequence |
|---|---|---|
| 3309 | 276113_96B22_97797 AlleleX | GAAGGTGACCAAGTTCATGCTGTACTATGGCTAT GTCTCTGAATGC |
| 3310 | CAP7_c3847_204 AlleleX | GAAGGTGACCAAGTTCATGCTCATTCGACGCGTC TTCCGCAATA |
| 3311 | Tdurum_contig50667_306 AlleleX | GAAGGTGACCAAGTTCATGCTGATGACATGGAGG ATTATATCGACGA |
| 3312 | cfn0856945 AlleleX | GAAGGTGACCAAGTTCATGCTGCACATGCTTTATT ACTGATCTGATTTG |
| 3313 | S100067637 AlleleX | GAAGGTGACCAAGTTCATGCTCCAAATGTCCGAA TTCAGAGCAG |
| 3404 | S100069923 AlleleX | GAAGGTGACCAAGTTCATGCTACATATACGCGAG CGCTCCTG |
| 3315 | S3045171 AlleleX | GAAGGTGACCAAGTTCATGCTGGTTCTTGGCACA CTCCCCAG |
| 3316 | S3045222 AlleleX | GAAGGTGACCAAGTTCATGCTAACCTAAGTAGTAA GCTTGCTGGGT |
| 3317 | cfn0238384 Allele Y | GAAGGTCGGAGTCAACGGATTGTAAAAGATGTC TGTGTGTCTAGG |
| 3318 | cfn0523109 Allele Y | GAAGGTCGGAGTCAACGGATTGTGAACAAAACAG GCCTACAATCC |
| 3319 | cfn0560679 Allele Y | GAAGGTCGGAGTCAACGGATTCAATGATGTTTAA CATTGGAACGGTCT |
| 3320 | cfn0917304 Allele Y | GAAGGTCGGAGTCAACGGATTGGTGGTGGCGCT CTACCCT |
| 3321 | cfn0919993 Allele Y | GAAGGTCGGAGTCAACGGATTCAAGTCATCGACT TACATGCTTCTTTT |
| 3322 | cfn0920459 Allele Y | GAAGGTCGGAGTCAACGGATTAGCCAAGGAAGC CCAGATTTTG |
| 3323 | cfn1087371 Allele Y | GAAGGTCGGAGTCAACGGATTGGGGAACTTTGG GTATACACCG |
| 3324 | cfn1252000 Allele Y | GAAGGTCGGAGTCAACGGATTGTTAATGCTGTAG CCATTCTTGCAG |
| 3325 | BWS0267 Allele Y | GAAGGTCGGAGTCAACGGATTCAGCTGCATAAAA AMCAGAATACCG |
| 3326 | cfn0524469 Allele Y | GAAGGTCGGAGTCAACGGATTGCACGTAGTAAGT ATTGATTTTCTGTT |
| 3327 | cfn0527067 Allele Y | GAAGGTCGGAGTCAACGGATTCAAATTACTTTGT TCTTTTATTTTTTCGAAC |
| 3328 | cfn0527718 Allele Y | GAAGGTCGGAGTCAACGGATTATAAATTGTTCACA ACATGGACATGAGAAT |
| 3329 | cfn1082074 Allele Y | GAAGGTCGGAGTCAACGGATTCTTACTGATAAAAT CCGGTTCAAATATATAAT |
| 3330 | cfn1239345 Allele Y | GAAGGTCGGAGTCAACGGATTGCTTCTTTTTTCTC CCTATAATATGGG |
| 3331 | cfn0554333 Allele Y | GAAGGTCGGAGTCAACGGATTGAGAGGCATCACA TAGGCATAC |
| 3332 | cfn0436720 Allele Y | GAAGGTCGGAGTCAACGGATTCTTCATTCCTTACA ACAAATATACCAAATC |

TABLE 5-continued

Primers for use in detecting fertility restorer SNP markers of the invention (as indicated in the primer name)

| SEQ ID NO | ID | Sequence |
|---|---|---|
| 3333 | cfn0522096 Allele Y | GAAGGTCGGAGTCAACGGATTAGTAGAATACCAC CCAATAAATCACTC |
| 3334 | cfn0523072 Allele Y | GAAGGTCGGAGTCAACGGATTAACTCTAGCGCAT GAGGTCTATCA |
| 3335 | cfn0523990 Allele Y | GAAGGTCGGAGTCAACGGATTATACATGAAGAGT GCAGGCACACT |
| 3336 | cfn0524921 Allele Y | GAAGGTCGGAGTCAACGGATTGTTTCCATGTTAA GCTTATATTGTGCG |
| 3337 | cfn0528390 Allele Y | GAAGGTCGGAGTCAACGGATTAAACATCTATTCC AAGCAAGTATTAGTAAC |
| 3338 | cfn0530841 Allele Y | GAAGGTCGGAGTCAACGGATTCTTCTTGTTTATAT ATTCTCTTATCAGAAGTT |
| 3339 | cfn1122326 Allele Y | GAAGGTCGGAGTCAACGGATTGGAATCTGATTAA GACGCTGGAGAAT |
| 3340 | cfn1249269 Allele Y | GAAGGTCGGAGTCAACGGATTCAAAGAGGTGACA AATATGTGTACC |
| 3341 | contig46312 Allele Y_253_BS00090770 | GAAGGTCGGAGTCAACGGATTAGGTCGTAGCACA TAGCCGTTTAT |
| 3342 | 219K1_110042 Allele Y | GAAGGTCGGAGTCAACGGATTCGGAATCGAGTCA ACCAATTCCC |
| 3343 | cfn0373248 Allele Y | GAAGGTCGGAGTCAACGGATTAACAACAATTAYG AGGATCAAATGGTCT |
| 3344 | cfn0527763 Allele Y | GAAGGTCGGAGTCAACGGATTCTAGCCACGCAAA TGCCCGC |
| 3345 | cfn0556874 Allele Y | GAAGGTCGGAGTCAACGGATTGAAAGAGCATGTC AGACACAATGCAA |
| 3346 | cfn1097828 Allele Y | GAAGGTCGGAGTCAACGGATTGGTTCCTGAGAGA GCAACCG |
| 3347 | cfn1246088 Allele Y | GAAGGTCGGAGTCAACGGATTGACATCTGATGAG CCAGCATACC |
| 3348 | cfn1258380 Allele Y | GAAGGTCGGAGTCAACGGATTCTACTCATCTATT GCAGATGCTCTG |
| 3349 | cfn1270524 Allele Y | GAAGGTCGGAGTCAACGGATTAAATGCCTAGTCT ATACCTGATAAACTAAT |
| 3350 | cfn1287194 Allele Y | GAAGGTCGGAGTCAACGGATTCACCTCCTCCGTA TCTGATGGT |
| 3351 | cfn1288811 Allele Y | GAAGGTCGGAGTCAACGGATTAATTTGGTTAACC AAATCCTTTTGATTTTG |
| 3352 | cfn1291249 Allele Y | GAAGGTCGGAGTCAACGGATTCTTCCCAGATTTA GCATGTGCATG |
| 3353 | cfn0231871 Allele Y | GAAGGTCGGAGTCAACGGATTCTACTGTATTAAAT TAGCTAGTGTGGCT |
| 3354 | cfn0393953 Allele Y | GAAGGTCGGAGTCAACGGATTAAAAAAACAAGTT GTCACCCAGATGAATT |
| 3355 | cfn0867742 Allele Y | GAAGGTCGGAGTCAACGGATTGGCATCCTCGACA ATGATTTCATCT |
| 3356 | cfn3126082 Allele Y | GAAGGTCGGAGTCAACGGATTTTAGCACCTAACG CCGCAAC |

TABLE 5-continued

Primers for use in detecting fertility restorer SNP markers of the invention (as indicated in the primer name)

| SEQ ID NO | ID | Sequence |
|---|---|---|
| 3357 | 104A4_105172 Allele Y | GAAGGTCGGAGTCAACGGATTCTGTCGMACCCAA TGAATAATGTTC |
| 3358 | 104A4_105588 Allele Y | GAAGGTCGGAGTCAACGGATTGTTCCTTGTGACA TGTACTCATAC |
| 3359 | 136H5_3M5_1382 11 Allele Y | GAAGGTCGGAGTCAACGGATTACTGGGTGCAAAG CCAAGATGATA |
| 3360 | 136H5_3M5_64154 Allele Y | GAAGGTCGGAGTCAACGGATTGCGAAACTTCGCC GCGATAAAC |
| 3361 | 136H5_3M5_68807 Allele Y | GAAGGTCGGAGTCAACGGATTAAGTTGCTCTTAA TTATCTGTGCGTG |
| 3362 | 136H5_3M5_7601 Allele Y | GAAGGTCGGAGTCAACGGATTGTCCCCCATGGCA CCTGC |
| 3363 | 136H5_3M5_77916 Allele Y | GAAGGTCGGAGTCAACGGATTAGCAAGTAGAGTT AACTTATCAAGTTATTG |
| 3364 | 136H5_3M5_89176 Allele Y | GAAGGTCGGAGTCAACGGATTTTCTCACCGGCAT CTCCG |
| 3365 | 136H5_3M5_89263 Allele Y | GAAGGTCGGAGTCAACGGATTCTTCCCATGTTCT TTTTTGCTCAAAAT |
| 3366 | 219K1_107461 Allele Y | GAAGGTCGGAGTCAACGGATTATATTGTTTGTATT AAAAAGTTGTGTGTTTTGC |
| 3367 | 219K1_110005 Allele Y | GAAGGTCGGAGTCAACGGATTCGCCTTTTCTTCTT CCAGCATCTAT |
| 3368 | 219K1_111446 Allele Y | GAAGGTCGGAGTCAACGGATTAATCGTTCTTCGA GAAGCACTCC |
| 3369 | 219K1_158251 Allele Y | GAAGGTCGGAGTCAACGGATTCCTGGAGATGGAT CCGGTCAA |
| 3370 | 219K1_166464 Allele Y | GAAGGTCGGAGTCAACGGATTGCCTGAGCTGGG CTGCACT |
| 3371 | 219K1_37 Allele Y | GAAGGTCGGAGTCAACGGATTACAAAGGGCTATC CTGGTGAACAAT |
| 3372 | 219K1_99688 Allele Y | GAAGGTCGGAGTCAACGGATTGCCCTGCGCAAAA TCAAACTC |
| 3373 | 276I13_96B22_97797 Allele Y | GAAGGTCGGAGTCAACGGATTAAGTACTATGGCT ATGTCTCTGAATGT |
| 3374 | CAP7_c3847_204 Allele Y | GAAGGTCGGAGTCAACGGATTCGACGCGTCTTCC GCAATG |
| 3375 | Tdurum_contig50667_306 Allele Y | GAAGGTCGGAGTCAACGGATTATGACATGGAGGA TTATATCGACGG |
| 3376 | cfn0856945 Allele Y | GAAGGTCGGAGTCAACGGATTGGCACATGCTTTA TTACTGATCTGATTTT |
| 3377 | S100067637 Allele Y | GAAGGTCGGAGTCAACGGATTCCAAATGTCCGAA TTCAGAGCAC |
| 3378 | S100069923 Allele Y | GAAGGTCGGAGTCAACGGATTGTACATATACGCG AGCGCTCCTA |
| 3379 | S3045171 Allele Y | GAAGGTCGGAGTCAACGGATTGGTTCTTGGCACA CTCCCCAA |
| 3380 | S3045222 Allele Y | GAAGGTCGGAGTCAACGGATTCCTAAGTAGTAAG CTTGCTGGGC |

TABLE 5-continued

Primers for use in detecting fertility restorer SNP markers of the invention (as indicated in the primer name)

| SEQ ID NO | ID | Sequence |
|---|---|---|
| 3381 | cfn0238384 Common | AGGGGGGCGTACGGGGTGA |
| 3382 | cfn0523109 Common | GTGTGTGCTAATGTGGATATACGTAAGTT |
| 3383 | cfn0560679 Common | GACGTTGAAGGGGGCATAGATCAAA |
| 3384 | cfn0917304 Common | CAACTGCTTGGAGAAAGGCAACACAA |
| 3385 | cfn0919993 Common | CCATTAACAAGTACTGCATAGGTGCATAT |
| 3386 | cfn0920459 Common | CCTCCTCCTAATTAAGCTCCTATAGATA |
| 3387 | cfn1087371 Common | CCCCCTTCTTCTTTCACTAGGGTAA |
| 3388 | cfn1252000 Common | GTGCCCATAAGACGACTGGGACAA |
| 3389 | BWS0267 Common | CTGCGTTAAGGTTCAGGCAACTGAT |
| 3390 | cfn0524469 Common | GCCAATTTTCAAATCTAAGTCCACAGAGA |
| 3391 | cfn0527067 Common | ATATGATTCACCCTAGATCCTTCACCTTA |
| 3392 | cfn0527718 Common | GTTTCCTCCAATGTTCTTCCC |
| 3393 | cfn1082074 Common | TGTCTCGCCTCGCTCTGGTTAATTT |
| 3394 | cfn1239345 Common | ACCCTCGCTGCAGTTCCTTCTTAAA |
| 3395 | cfn0554333 Common | AAATTCACACCATCATTGATCTGGGGTAT |
| 3396 | cfn0436720 Common | GTCCACTGAGAATTAAGGATGCATTCTTT |
| 3397 | cfn0522096 Common | AAGTAGTACTCGTAGAGAGTTAACACAGA |
| 3398 | cfn0523072 Common | GCTTGACAATGATAATGCCCCCGAA |
| 3399 | cfn0523990 Common | AATAACTCTTGTACTTCAGGATGAACGTTT |
| 3400 | cfn0524921 Common | GCCCTTTGGTAATTCCATTTCAATCTTTT |
| 3401 | cfn0528390 Common | GATGAGGAAGGTCTTCATGTTGGGTT |
| 3402 | cfn0530841 Common | GAGCAGCACATCGTTAGCTGTTCTA |
| 3403 | cfn1122326 Common | CAGATGGCCTAGTCGTGACATATCTT |
| 3404 | cfn1249269 Common | TAAAAGAACACAAATGTGGCCCTAGTGAT |

TABLE 5-continued

Primers for use in detecting fertility restorer SNP markers of the invention (as indicated in the primer name)

| SEQ ID NO | ID | Sequence |
|---|---|---|
| 3405 | contig46312_253_BS00090770 Common | GAAACATTCCTTCGGACAACTATGCATTA |
| 3406 | 219K1_110042 Common | GCATCTTCAAGGGAGCCACTCAAAA |
| 3407 | cfn0373248 Common | ATCATTGCCACGRAAAAAATCTCACAAGAT |
| 3408 | cfn0527763 Common | CCTTGTCCACCGAGACATGTACAAA |
| 3409 | cfn0556874 Common | CCTGCTGGAAATGGGATTTCTTGTTTATT |
| 3410 | cfn1097828 Common | GCTTCCTCTCGGTAGCGATGGAT |
| 3411 | cfn1246088 Common | GGGACGTGGAATTTGGAAAGACACAT |
| 3412 | cfn1258380 Common | TATAGGAGTGATAGCACCACACAATTCAT |
| 3413 | cfn1270524 Common | TGTACCGAAACTCAACCAAATGACCATTT |
| 3414 | cfn1287194 Common | CAGAAGGCACTGGGAGGGGATT |
| 3415 | cfn1288811 Common | GCACAATGTTTGACATTCGGTTTTCTAGTT |
| 3416 | cfn1291249 Common | CTGACTGTCGTATCTTCAACATACTGATT |
| 3417 | cfn0231871 Common | CCAAGGTATATGTGCCATTATCCTCAAA |
| 3418 | cfn0393953 Common | CACTCACCGTCGACATTGACATAGTT |
| 3419 | cfn0867742 Common | AGCCTCCGCGTCGTGATGGAAT |
| 3420 | cfn3126082 Common | AAAGGGACAGCGATTTGATCTGG |
| 3421 | 104A4_105172 Common | GCCATCCTCTCGGAGCCAGAA |
| 3422 | 104A4_105588 Common | CAAGGATGGGAGTATATGGCTCTT |
| 3423 | 136H5_3M5_138211 Common | CCTCCCAACGGCCATCAATCAATTT |
| 3424 | 136H5_3M5_64154 Common Common | GATCATCGGGGAACCTGATGATAGTT |
| 3425 | 136H5_3M5_68807 Common | TTGGTTGGTTACGTCAGGTTAAGACTTA |
| 3426 | 136H5_3M5_7601 Common | CTTCTCTGTGGCCGAAAACCTCTT |
| 3427 | 136H5_3M5_77916 Common | GCTKTAGACTCTAAGTACCACAGAAGAA |
| 3428 | 136H5_3M5_89176 Common | CCTACCATCCTTAAATACTCTTGCTCAAA |

TABLE 5-continued

Primers for use in detecting fertility restorer SNP markers of the invention (as indicated in the primer name)

| SEQ ID NO | ID | Sequence |
|---|---|---|
| 3429 | 136H5_3M5_89263 Common | AAGCAACTAGAAAAATATTTGGACTAGCAT |
| 3430 | 219K1_107461 Common | GTTGATGCGAATTTGAAAATGACATAATAA |
| 3431 | 219K1_110005 Common | TTGACTCGATTCCGTGTGAGGCTAA |
| 3432 | 219K1_111446 Common | AATATGATACAGACCCAAGACAAACCATTT |
| 3433 | 219K1_158251 Common | TCCTCACAAATCACGGGCCCCT |
| 3434 | 219K1_166464 Common | GACCGTGGTATATGCCACCACGTT |
| 3435 | 219K1_37 Common | GGCTTCATTATCAAATTCTGACCCATCTT |
| 3436 | 219K1_99688 Common | GGGCGGGACCTGACTTGATGAT |
| 3437 | 276I13_96B22_97797 Common | ACGACAATATAGACAAATAAAACCAAACAA |
| 3438 | CAP7_c3847_204 Common | CCGCGGCCGAAGCAGGCAA |
| 3439 | Tdurum_contig50667_306 Common | ATACATGTCGGCGTCCCAGTCC |
| 3440 | cfn0856945 Common | GGTGTAGGCAAACCTAAAATAAACAGTCAA |
| 3441 | S100067637 Common | CAACGCCAAACGCCAACGCCAT |
| 3442 | S100069923 Common | GCCTTGTACTGCAGTGAAGTGTGAT |
| 3443 | S3045171 Common | TGACGGCTGCGAGGACGAGAAT |
| 3444 | S3045222 Common | AGTCCAGAGTTACAGGACATGGCTA |

Use of the Wheat Plants of the Disclosure

The plant according to the disclosure can be crossed, with any another inbred line, in order to produce a new line comprising either an increase or a decrease in the fertility level. Alternatively, a genetic trait which has been engineered into a particular line using the foregoing techniques could be moved into another line using traditional backcrossing techniques that are well known in the plant breeding arts. For example, a backcrossing approach could be used to move an engineered trait from a public, non-elite inbred line into an elite inbred line, or from an inbred line containing a foreign gene in its genome into an inbred line or lines which do not contain that gene. As used herein, "crossing" can refer to a simple X by Y cross, or the process of backcrossing, depending on the context.

The wheat plant of the disclosure is also a wheat plant wherein one or more desired traits have further been introduced through backcrossing methods, whether such trait is a naturally occurring one or not.

The disclosure also relates to the use of the wheat plant as described above or its seeds, for food applications, preferably for flour production and for feed applications, or for breeding applications, for example for use as a parent plant in breeding for improving agronomical value of a wheat plant, line, hybrid or variety.

As used herein, breeding applications encompass pedigree breeding to improve the agronomical value of a plant, line, hybrid, or variety.

The wheat plants disclosed herein are further useful, for example, for producing flour or for feed applications.

Seeds harvested from plants described herein can be used to make flour by any available techniques in the art. The wheat plants or their flour are also useful as food compositions, for human or animal.

The Examples below are given for illustration purposes only.

Specific Embodiments

1. An isolated nucleic acid encoding a protein restorer of fertility of *T. timopheevii*, wherein the corresponding amino acid sequence has at least 95% identity to an amino acid sequence chosen amongst any one of SEQ ID NO:1 to SEQ ID NO: 1554.
2. The nucleic acid of Embodiment 1, encoding a Rf1 protein restorer of fertility of *T. timopheevii* CMS cytoplasm, wherein the corresponding amino acid sequence has at least 95% identity, preferably at least 96%, 97%, 98%, 99% or 100% identity to an amino acid sequence selected from the group consisting of SEQ ID NOs 1-2, SEQ ID NOs 288-290, SEQ ID NOs 293-296, SEQ ID NOs 343-346, SEQ ID NOs 349-354, SEQ ID NOs 359, 361 and 362, SEQ ID NOs 396 and 397, SEQ ID NOs 428-430, SEQ ID NO 517 and 519, SEQ ID NOs 752-754, SEQ ID NOs 1092, 1093 and 1095.
3. The nucleic acid of Embodiment 1, encoding a Rf1 protein restorer of fertility of *T. timopheevii* CMS cytoplasm, wherein the corresponding amino acid sequence has at least 95% identity, preferably at least 96%, 97%, 98%, 99% or 100% identity to SEQ ID NO:361.
4. The nucleic acid of claim 1, encoding a Rf3 protein restorer of fertility of *T. timopheevii* CMS cytoplasm, wherein the corresponding amino acid sequence has at least 95% identity, preferably at least 96%, 97%, 98%, 99% or 100% identity to an amino acid selected from the group consisting of SEQ ID NOs: 124 and 125, SEQ ID NO:147, SEQ ID NO: 150, SEQ ID NO: 156, SEQ ID NO:158, SEQ ID NO:297, SEQ ID NO:299, SEQ ID NOs: 315-321, SEQ ID NOs: 379-381, SEQ ID NOs: 553 and 554, SEQ ID NOs: 557 and 558, SEQ ID NOs: 676 and 677, SEQ ID NOs: 684 and 685, SEQ ID NOs: 696 and 697, SEQ ID NOs: 938 and 939 and SEQ ID NOs: 1038 and 1039.
5. The nucleic acid of Embodiment 4, encoding Rf3 protein restorer of fertility of *T. timopheevii* CMS cytoplasm, wherein the corresponding amino acid sequence has at least 95% identity, preferably at least 96%, 97%, 98%, 99% or 100% identity to an amino acid selected from the group consisting of SEQ ID NO: 158, SEQ ID NO: 676 and SEQ ID NO:684.
6. The nucleic acid of Embodiment 1, encoding a Rf4 protein restorer of fertility of *T. timopheevii* CMS cytoplasm, wherein the corresponding amino acid sequence has at least 95% identity, preferably at least 96%, 97%, 98%, 99% or 100% identity to an amino acid selected from the group consisting of SEQ ID NO: 477 and SEQ ID NOs 3135-3138.
7. The nucleic acid of Embodiment 1, encoding a Rf7 protein restorer of fertility of *T. timopheevii* CMS cytoplasm, wherein the corresponding amino acid sequence has at least 95% identity, preferably at least 96%, 97%, 98%, 99% or 100% identity to an amino acid sequence selected from the group consisting of SEQ ID NOs: 240-243, SEQ ID NOs 303-305, SEQ ID NO:363, SEQ ID NOs 375-377, SEQ ID NOs 497-499, SEQ ID NO:516, SEQ ID NOs 709-711, SEQ ID NO:768.
8. The nucleic acid of Embodiment 1 encoding for a Rf-rye protein restorer of fertility of *T. timopheevii* CMS cytoplasm, wherein the corresponding amino acid sequence has at least 95% identity, preferably at least 96%, 97%, 98%, 99% or 100% identity to an amino acid sequence selected from the group consisting of SEQ ID NO:227, SEQ ID NO:378 and SEQ ID NO:859.
9. A recombinant nucleic acid comprising a nucleic acid encoding a protein restorer of *T. timopheevii* CMS cytoplasm of any one of Embodiments 1 to 8, operably linked to regulatory elements.
10. A vector for use in transformation of a wheat plant, comprising the recombinant nucleic acid of Embodiment 9.
11. A wheat transgenic plant comprising one or more nucleic acid(s) of any one of Embodiments 1-9, as transgenic element(s).
12. The wheat transgenic plant of Embodiment 11, which is a fertile wheat plant restorer of *T. timopheevii* CMS cytoplasm and comprising a combination of at least two different transgenic elements, selected from the group consisting of Rf1, Rf3, Rf7 and Rf-rye nucleic acids of any one of Embodiments 1-9.
13. The transgenic wheat plant of Embodiment 11 or 12, wherein said transgenic plant includes the following combination of nucleic acids as transgenic elements:
    a. a Rf1 nucleic acid encoding an amino acid sequence having at least 95% identity to any one of SEQ ID NOs 359, 361, 362 or SEQ ID NOs 428-430, and Rf3 nucleic acid encoding an amino acid sequence having at least 95% identity to any one of SEQ ID NOs: 315-321, SEQ ID NOs: 379-381, SEQ ID NOs: 147 and 150, SEQ ID NOs: 156 and 158, SEQ ID NOs 297 and 299, SEQ ID NO:676 and SEQ ID NO:684,
    b. a Rf1 nucleic acid encoding an amino acid sequence having at least 95% identity to any one of SEQ ID NOs 359, 361, 362 or SEQ ID NOs 428-430, and Rf7 nucleic acid encoding an amino acid sequence having at least 95% identity to any one of SEQ ID NO:363, SEQ ID NO: 516 and SEQ ID NO:768,
    c. a Rf1 nucleic acid encoding an amino acid sequence having at least 95% identity to any one of SEQ ID NOs 359, 361, 362 or SEQ ID NOs 428-430, and Rf-rye nucleic acid encoding an amino acid sequence having at least 95% identity to any one of SEQ ID NO:227, SEQ ID NO: 378 and SEQ ID NO: 859,
    d. a Rf3 nucleic acid encoding an amino acid sequence having at least 95% identity to any one of SEQ ID NOs: 315-321, SEQ ID NOs: 379-381, SEQ ID NOs: 147 and 150, SEQ ID NOs: 156 and 158, SEQ ID NOs 297 and 299, SEQ ID NO:676 and SEQ ID NO:684, and Rf7 nucleic acid encoding an amino acid sequence having at least 95% identity to SEQ ID NO: 363, SEQ ID NO:516 and SEQ ID NO:768,
    e. a Rf3 nucleic acid encoding an amino acid sequence having at least 95% identity to any one of SEQ ID NOs: 315-321, SEQ ID NOs: 379-381, SEQ ID NOs: 147 and 150, SEQ ID NOs: 156 and 158, SEQ ID NOs 297 and 299, SEQ ID NO:676 and SEQ ID NO:684, and Rf-rye nucleic acid encoding an amino acid sequence having at least 95% identity to any one of SEQ ID NO:227, SEQ ID NO:378 and SEQ ID NO:859,
    f. a Rf7 nucleic acid encoding an amino acid sequence having at least 95% identity to SEQ ID NO:363, SEQ ID NO:516 and SEQ ID NO:768, and Rf-rye nucleic acid encoding an amino acid sequence having at least 95% identity to any one of SEQ ID NO:227, SEQ ID NO:378 and SEQ ID NO:859,
    g. a Rf1 nucleic acid encoding an amino acid sequence having at least 95% identity to any one of SEQ ID NOs 359, 361, 362 or SEQ ID NOs 428-430, and Rf3 nucleic acid encoding an amino acid sequence having at least 95% identity to any one of SEQ ID NOs: 315-321, SEQ ID NOs: 379-381, SEQ ID NOs: 147 and 150, SEQ ID NOs: 156 and 158, SEQ ID NOs 297 and 299, SEQ ID NO:676 and SEQ ID NO:684, and Rf7 nucleic acid encoding an amino acid sequence having at least 95% identity to any one of SEQ ID NO:363, SEQ ID NO:516 and SEQ ID NO: 768;

h. a Rf1 nucleic acid encoding an amino acid sequence having at least 95% identity to any one of SEQ ID NOs 359, 361, 362 or SEQ ID NOs 428-430, and Rf3 nucleic acid encoding an amino acid sequence having at least 95% identity to any one of SEQ ID NOs: 315-321, SEQ ID NOs: 379-381, SEQ ID NOs: 147 and 150, SEQ ID NOs: 156 and 158, SEQ ID NOs 297 and 299, SEQ ID NO:676 and SEQ ID NO:684, and Rf-rye nucleic acid encoding an amino acid sequence having at least 95% identity to any one of SEQ ID NO:227, SEQ ID NO:378 and SEQ ID NO: 859;

i. a Rf1 nucleic acid encoding an amino acid sequence having at least 95% identity to any one of SEQ ID NOs 359, 361, 362 or SEQ ID NOs 428-430, and Rf7 nucleic acid of Embodiment 4 encoding an amino acid sequence having at least 95% identity to any one of SEQ ID NO: 363, SEQ ID NO:516 and SEQ ID NO:768, and Rf-rye nucleic acid encoding an amino acid sequence having at least 95% identity to any one of SEQ ID NO:227, SEQ ID NO:378 and SEQ ID NO:859; or, j. a Rf3 nucleic acid encoding an amino acid sequence having at least 95% identity to any one of SEQ ID NOs: 315-321, SEQ ID NOs: 379-381, SEQ ID NOs: 147 and 150, SEQ ID NOs: 156 and 158, SEQ ID NOs 297 and 299, SEQ ID NO:676 and SEQ ID NO:684, and Rf7 nucleic acid encoding an amino acid sequence having at least 95% identity to any one of SEQ ID NO:363, SEQ ID NO:516 and SEQ ID NO:768, and Rf-rye nucleic acid encoding an amino acid sequence having at least 95% identity to any one of SEQ ID NO:227, SEQ ID NO:378 and SEQ ID NO: 859.

14. The transgenic wheat plant of Embodiment 13, which further contains a Rf4 nucleic acid encoding a Rf4 protein restorer of fertility of T. timopheevii CMS cytoplasm, in combination with one, two, three or four of any of the restorer nucleic acid encoding Rf1, Rf3, Rf7 or Rf-rye protein, wherein the corresponding amino acid sequence has at least 95% identity, preferably at least 96%, 97%, 98%, 99% or 100% identity to an amino acid selected from the group consisting of SEQ ID NO:477 and SEQ ID NOs 3135-3138.

15. The transgenic wheat plant of any one of Embodiments 11-14, wherein said one or more transgenic element(s) express polypeptides which restore or improve male fertility to the plant as compared to the parent plant without such transgenic element(s).

16. Method for producing a wheat transgenic plant of any one of Embodiments 11-15, wherein the method comprises the steps of transforming a parent wheat plant with one or more nucleic acids encoding protein restorer of T. timopheevii CMS cytoplasm according to any one of Embodiments 1-9, selecting a plant comprising said one or more nucleic acid(s) as transgene(s), regenerating and growing said wheat transgenic plant.

17. A method for producing a wheat plant carrying a Rf3 restorer of fertility, said method comprising (i) providing a parent wheat plant comprising in its genome at least a 163 bp fragment of SEQ ID NO:3174, and (ii) deleting a region of at least 10 bp in said fragment of SEQ ID NO:3174, for example at least 20 bp, 30 bp, 40 bp, 50 bp, 60 bp, 70 bp, 80 bp, 90 bp, 100 bp, 110 bp, 120 bp, 130 bp, 140 bp, 150 bp, 160 bp or the whole fragment of SEQ ID NO:3174 in the genome of said wheat plant, thereby obtaining said wheat plant carrying a Rf3 restorer of fertility.

18. The method of Embodiment 17, wherein the fertility score of the obtained wheat plant has a fertility score higher than the parent wheat plant.

19. The method of Embodiment 17 or 18, wherein the parent wheat plant has a fertility score below 1, for example comprised between 0.5 and 1.0 and the obtained wheat plant has a fertility score above 1.0, for example comprised between 1.0 and 2.0.

20. A wheat plant carrying Rf3 restorer of fertility, as obtained by the method of any one of Embodiments 17-19, wherein only a part but not the whole genomic fragment of SEQ ID NO:3174 is deleted in the genome of said wheat plant.

21. A method for assessing fertility restoration in a wheat plant, said method comprising determining the presence or absence of a fragment of SEQ ID NO: 3174 in the genome of said plant, wherein the presence of the whole fragment is indicative of a weak restoration of fertility and a deletion of at least a part of such fragment or the whole fragment of SEQ ID NO:3174 is indicative of a strong restoration of fertility.

22. A nucleic acid probe for use in a method of any one of Embodiments 17-21, characterized it consists of a nucleic acid of at least 10 nucleotides within SEQ ID NO: 3174.

23. A wheat plant restorer of fertility of T. timopheevii CMS cytoplasm, wherein the plant comprises at least three fertility restorer alleles within the restorer loci chosen amongst Rf1, Rf3, Rf4 and Rf7 wherein,
    a. the Rf1 locus is located at most 10 cM from marker cfn0522096 of SEQ ID NO: 3190 or marker cfn05277067 of SEQ ID NO: 3196,
    b. the Rf3 locus is located at most 10 cM from marker cfn1249269 of SEQ ID NO: 3205 or marker BS00090770 of SEQ ID NO:3228,
    c. the Rf7 locus is located at most 10 cM from marker cfn0919993 of SEQ ID NO: 3231, and,
    d. the Rf4 locus is located at most 10 cM from marker cfn0393953 of SEQ ID NO: 3233.

24. The wheat plant of Embodiment 23, wherein the plant comprises the Rf1, Rf3 and Rf7 restorer alleles.

25. The wheat plant of any one of Embodiments 23 to 24, characterized in that it includes at least one Rf1 restorer allele within the Rf1 locus, said Rf1 restorer allele being located within the chromosomal interval between SNP markers cfn0522096 of SEQ ID NO:3190 and cfn05277067 of SEQ ID NO:3196.

26. The wheat plant of Embodiment 25, wherein said Rf1 locus is characterized by the presence of one or more of the following SNP allele(s):

| SNP# | Marker Name | Marker SEQ ID NO: | Restorer Allele |
|---|---|---|---|
| SNP1 | cfn523072 | 3187 | T |
| SNP2 | cfn0523109 | 3188 | A |
| SNP3 | 276I13_96B22_97797 | 3189 | C |
| SNP4 | cfn0522096 | 3190 | C |
| SNP5 | cfn0527763 | 3191 | C |
| SNP6 | 104A4_105172 | 3192 | TG |
| SNP7 | 104A4_105588 | 3193 | A |
| SNP8 | cfn0373248 | 3194 | T |
| SNP9 | cfn1097828 | 3195 | C |
| SNP10 | cfn0527067 | 3196 | A |
| SNP11 | cfn0528390 | 3197 | G |
| SNP12 | BWS0267 | 3198 | A |
| SNP13 | cfn0527718 | 3199 | T |
| SNP14 | cfn0524469 | 3200 | G |
| SNP15 | cfn0524921 | 3201 | G |
| SNP16 | cfn1122326 | 3202 | C |

27. The wheat plant of Embodiment 26, wherein the Rf1 locus is characterized by the haplotype "C" and "A" of the SNP3 and SNP7 restorer alleles as described in the table of Embodiment 5.

28. The wheat plant of any one of Embodiments 23 to 27, characterized in that it includes at least one Rf3 restorer allele within the Rf3 locus, said Rf3 restorer allele being located within the chromosomal fragment between SNP markers cfn1249269 and BS00090770.

29. The wheat plant of Embodiment 28, wherein said Rf3 locus is characterized by the presence of one or more of the following SNP allele(s):

| SNP# | Marker Name | Marker SEQ ID | Restorer Allele |
|---|---|---|---|
| SNP17 | cfn1252000 | 3203 | A |
| SNP18 | IWB14060* | 3204 | G |
| SNP19 | cfn1249269 | 3205 | G |
| SNP20 | 219K1_166464 | 3206 | T |
| SNP21 | 219K1_158251 | 3207 | G |
| SNP22 | 219K1_111446 | 3208 | A |
| SNP23 | 219K1_110042 | 3209 | T |
| SNP24 | 219K1_110005 | 3210 | C |
| SNP25 | 219K1_107461 | 3211 | A |
| SNP26 | 219K1_99688 | 3212 | T |
| SNP27 | 219K1_37 | 3213 | C |
| SNP28 | cfn1270524 | 3214 | T |
| SNP29 | 136H5_3M5_7601 | 3215 | T |
| SNP30 | cfn1288811 | 3216 | G |
| SNP31 | 136H5_3M5_89176 | 3217 | A |
| SNP32 | 136H5_3M5_89263 | 3218 | T |
| SNP33 | 136H5_3M5_138211 | 3219 | T |
| SNP34 | cfn0556874 | 3220 | C |
| SNP35 | 136H5_3M5_64154 | 3221 | C |
| SNP36 | 136H5_3M5_68807 | 3222 | G |
| SNP37 | 136H5_3M5_77916 | 3223 | A |
| SNP38 | cfn1246088 | 3224 | A |
| SNP39 | cfn1287194 | 3225 | G |
| SNP40 | cfn1258380 | 3226 | A |
| SNP41 | IWB72107* | 3227 | A |
| SNP42 | BS00090770 | 3228 | T |
| SNP43 | cfn1239345 | 3229 | A |

30. The wheat plant of Embodiment 29, wherein the Rf3 locus is characterized by the haplotype "T" and "A" of the SNP29 and SNP31 restorer alleles as described in the table of Embodiment 7.

31. The wheat plant of any one of Embodiments 23 to 30, wherein the Rf7 locus is characterized by the presence of one or more of the following restorer SNP allele(s):

| SNP# | Marker Name | Marker SEQ ID | Restorer Allele |
|---|---|---|---|
| SNP44 | cfn0917304 | 3230 | T |
| SNP45 | cfn0919993 | 3231 | G |
| SNP46 | cfn0920459 | 3232 | C |
| SNP49 | cfn0915987 | 3445 | G |
| SNP50 | cfn0920253 | 3446 | A |
| SNP51 | cfn0448874 | 3447 | T |
| SNP52 | cfn0923814 | 3448 | C |
| SNP53 | cfn0924180 | 3449 | G |
| SNP54 | cfn0919484 | 3450 | G |

32. The wheat plant of any one of Embodiments 23 to 31, wherein the Rf4 locus is characterized by the presence of one or more of the following SNP allele(s), preferably by the haplotype "C" and "G" of the SNP47 and SNP48 restorer alleles:

| SNP# | Marker Name | Marker SEQ ID | Restorer Allele |
|---|---|---|---|
| SNP47 | cfn0393953 | 3233 | C |
| SNP48 | cfn0856945 | 3234 | G |

33. The wheat plant of any one of Embodiments 23-32, wherein representative alleles of Rf1, Rf3, Rf4 and Rf7 restorer alleles are provided by the seed sample chosen amongst: NCIMB 42811, NCIMB 42812, NCIMB 42813, NCIMB 42814, NCIMB 42815, NCIMB 42816, and NCIMB 42817.

34. The wheat plant according to any one of the Embodiments 23 to 33, wherein said wheat plant is alloplasmic and comprises the *T. timopheevii* cytoplasm.

35. A method of identifying a wheat plant according to any one of Embodiments 23 to 34, wherein said wheat plant is identified by detecting the presence of at least one restorer allele genetically associated with the restorer loci chosen amongst Rf1, Rf3, Rf4 and Rf7 loci.

36. Means for detecting one or more of SNPs of SEQ ID NOs 3187-3235.

37. The means according to Embodiment 36 consisting of one or more primers including any one of the following: SEQ ID NOs 3253-3444.

38. Method of production of a wheat hybrid plant comprising the steps of:
   a. crossing a sterile female wheat plant comprising the *T. timopheevii* cytoplasm with a fertile male wheat plant according to any one of Embodiments 23 to 34;
   b. collecting the hybrid seed;
   c. optionally detecting the presence of *T. timopheevii* cytoplasm, and/or at least three of the Rf locus chosen amongst Rf1, Rf3, Rf4 and Rf7 in the hybrid seed; and,
   d. optionally detecting hybridity level of the hybrid seed.

LEGENDS OF THE FIGURES

FIGS. 1A and 1B is a table showing a summary of plant genomes used in the study and number of identified RFLs. In total, the analyses encompassed 16 genome data sets from Triticeae and 13 from Oryzeae, respectively, as well as single data sets from Brachypodium distachyon, tef (*Eragrostis tef*), rye (*Secale cereale*), foxtail millet (*Setaria italica*), sorghum (*Sorghum bicolor*) and maize (*Zea mays*). *Lolium perenne* and *Triticum turgidum* transcriptome data sets were used as well.

FIG. 2: Processing of orf256 in T-CMS wheat mitochondria (A) Structure of orf256 identified in the *T. timopheevii* mitochondrial genome. The binding site of the WORF256 probe (Song and Hedgoth 1994) used in the Northern blot analysis is indicated. (B) Differential processing of the orf256 in wheat lines with different restoring capabilities. No orf256 transcript was detected in *T. aestivum*, Primepii, Anapurna and Wheat-Rye-6R (WR_6R) lines. An additional, third band detected in R197 and R0934F accessions is indicated by asterisks. As a control for gel loading the picture of ethidium bromide (EtBr) stained agarose gel is shown.

FIG. 3: FIG. 3 shows the list of RFL groups potentially corresponding to the Rf4 gene.

FIGS. 4a and 4b: FIGS. 4A and 4B show respectively the alignment between nucleotide sequences of RFL120-spelt (Subject) (SEQ ID NO: 3136) with RFL120-timo (Query) (SEQ ID NO: 477) and amino acid sequences RFL120-17F3R-0377_1 (SEQ ID NO: 3135), RFL120-L13_1 (SEQ ID NO: 3137), RFL120-R113_1 (SEQ ID NO: 3138), RFL120-timo_1 (SEQ ID NO: 477), and RFL120-GSTR435_1 (SEQ ID NO: 3136).

FIG. 5A: FIG. 5A shows the protein sequence alignment of RFL29a (SEQ ID NO: 3146), RFL29b (SEQ ID NO: 3149), RFL29c_1 (SEQ ID NO: 3458) and RFL29c_2 (SEQ ID NO: 3459).

FIGS. 5B and 5C: FIGS. 5B and 5C respectively, show the protein sequence alignments of RFL164a (SEQ ID NO: 3147) and RFL164b (SEQ ID NO: 3144), and RFL166a (SEQ ID NO: 3148) and RFL166b (SEQ ID NO: 3145).

FIG. 6: FIG. 6 shows an alignment of the 5'UTR regions as identified in the RFL29a (SEQ ID NO: 3460) and RFL29b genes (SEQ ID NO: 3461).

Figure 7:
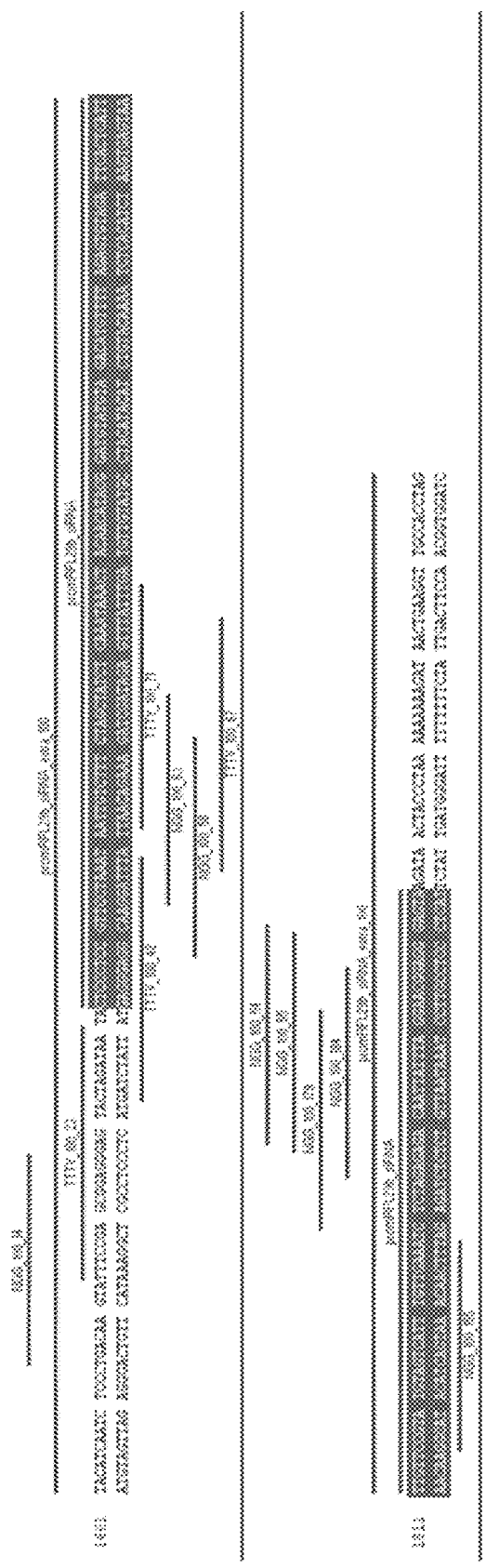

FIG. 7: FIG. 7 shows the position of the different target sequences around and within the 163 bp region (SEQ ID NO: 3155) identified for different endonucleases.

Figure 8:
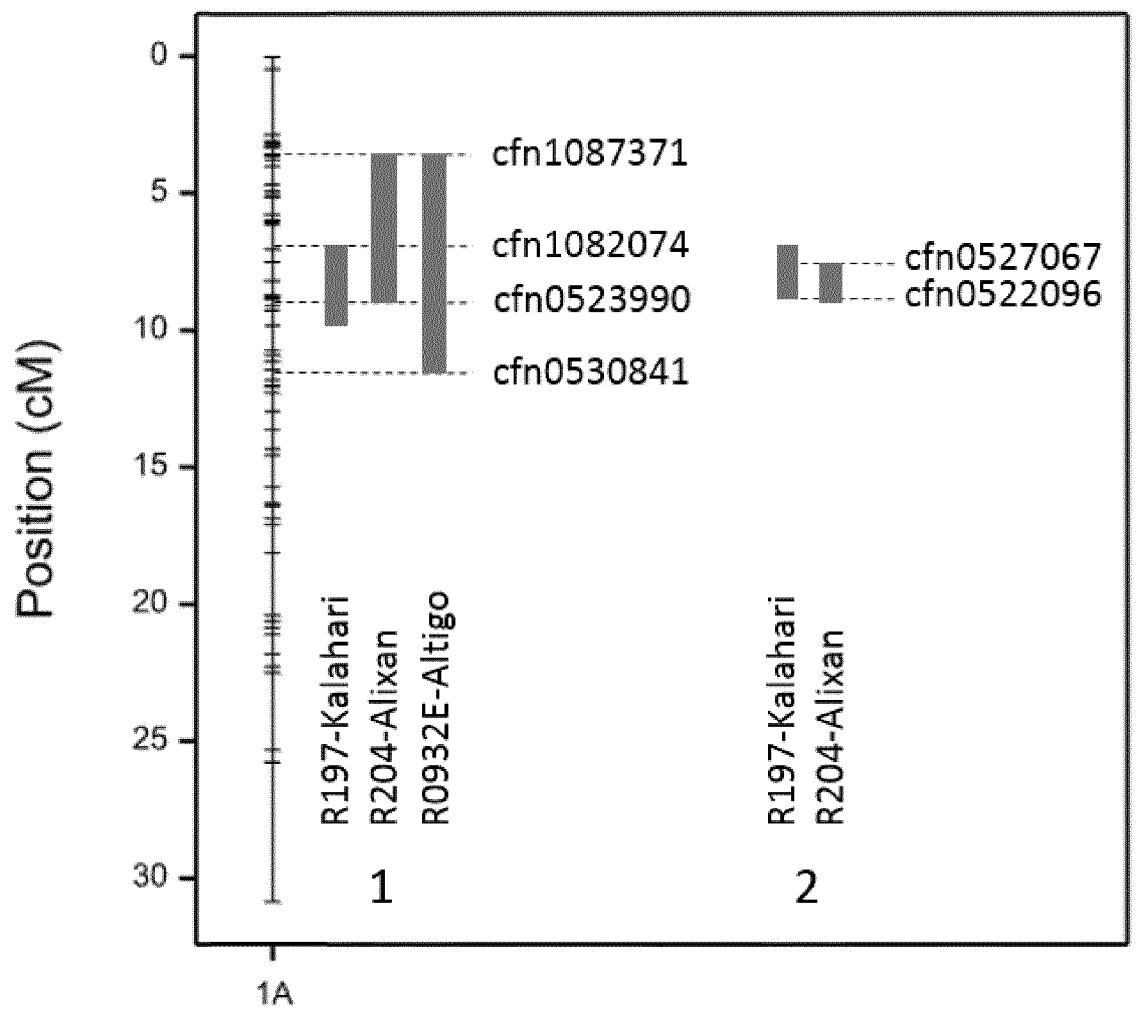

FIG. 8: The FIG. 8 shows the relative position of the Rf1 mapping intervals identified on our internal consensus genetic map.

Figure 9:
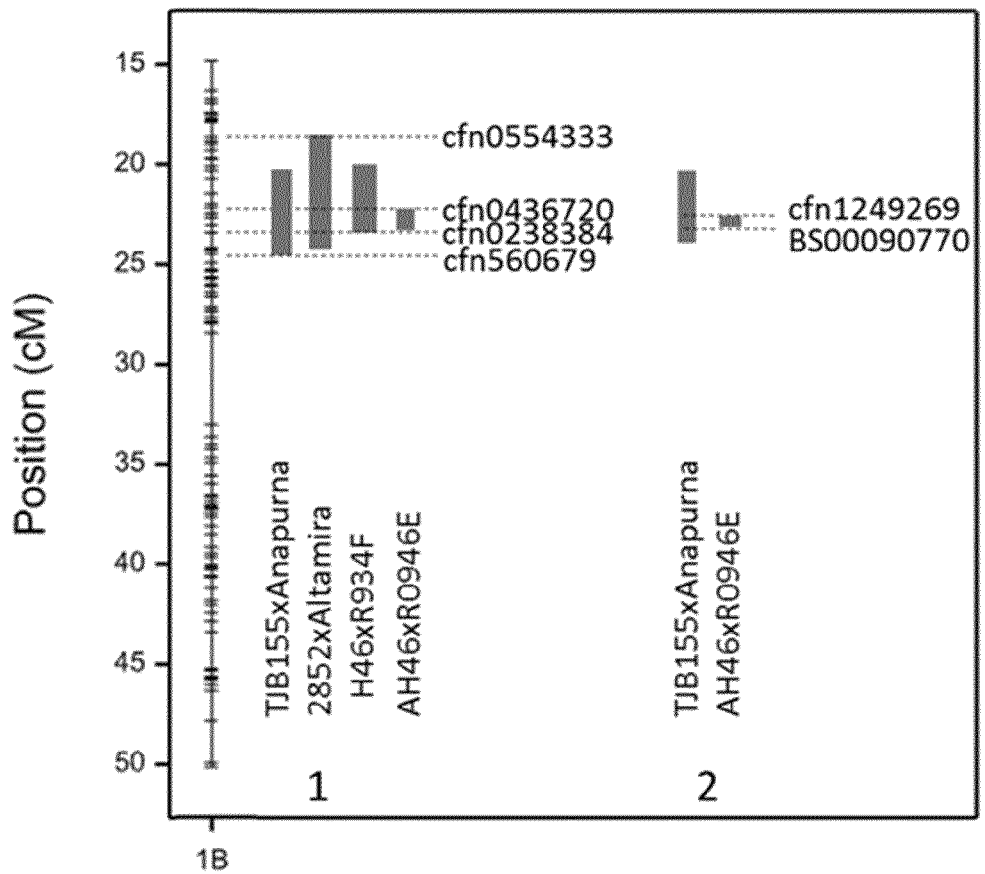

FIG. 9: The FIG. 9 shows the relative position of the Rf3 mapping intervals identified on our internal consensus genetic map.

FIG. 10: The FIG. 10A shows position of the markers within the chromosomal interval of Rf1 locus. Left and right refer to the marker positions relative to the interval defined by cfn0522096 and cfn0527067 SNP markers. Interval refers to markers located within the mapping interval. The physical positions correspond to LG internal ordering of the scaffolds of the IWGSC Whole genome assembly, 'IWGSC WGA'.

The FIGS. 10B, 10C, 10D show a subset of the diversity panel showing the haplotypes at the Rf1 locus for the restorer lines used in the genetic mapping (R197, R204, R0932E), derived lines LGWR16-0016 and LGWR16-0026 and a collection of maintainer lines. "-": correspond to dominant markers with no amplification in several maintainer lines. "H": means heterozygote status wherein two alleles are detected.

FIG. 11: The FIG. 11A shows the position of the markers within the chromosomal interval of Rf3 locus. Left and right refer to the marker positions relative to the interval defined by cfn1249269 and BS00090770 markers. Interval refers to markers located within the mapping interval. The physical positions correspond to LG internal ordering of the scaffolds of the IWGSC Whole genome assembly, 'IWGSC WGA'. *IWB14060 and IWB72107 are described in Geyer and al, 2016.

The FIGS. 11B, 11C, 11D show a subset of the diversity panel showing the haplotypes at the Rf3 locus for the restorer lines LGWR16-0016 and LGWR16-0026, the TJB155 line used as restorer parental line in Rf3 QTL mapping and a series of maintainer lines.

"-" corresponds to dominant markers with no amplification in several maintainer lines. "H" means heterozygote status wherein two alleles are detected.

FIG. 12: The FIG. 12 shows nucleotide sequence alignment between RFL29a (SEQ ID NO: 3146) and RFL29c (SEQ ID NO: 3157) fragment sequences. The PAM motif and target sequence for CRISPR edition are respectively is in bold and underligned.

EXAMPLES

Example 1: Identification of 1188 RFL-PPR Sequences in Cereals 32 genomic and two transcriptome data sets from 27 cereal plant species and their wild relatives were downloaded from the public sequence depositories and analysed. A complete list of files and databases from which they were downloaded is presented in FIG. 1.

The DNA sequences were screened for open reading frames (ORFs) in six-frame translations with the getorf program of the EMBOSS 6.6.0 package (Rice et al., 2000). Predicted ORFs longer than 92 codons were screened for the presence of P-and PLS-class pentatricopeptide repeat (PPR) motifs using hmmsearch from the HMMER 3.1b package (hmmer.org) and hidden Markov models defined by hmmbuild (Cheng et al., 2016). The post-processing of hmmsearch results was carried out according to rules described previously (Cheng et al., 2016). Sequences containing 10 or more P-class PPR motifs were retained for further analysis, as a previous study has shown that Restorer-to-Fertility-Like (RFL) genes are primarily comprised of tandem arrays of 15 to 20 PPR motifs (Fujii et al., 2011).

For identification of RFL sequences among the P-class PPRs, the OrthoMCL algorithm (Li et al., 2003) was used via the OrthoMCL-DB website to cluster P-class PPR proteins from each data set (http://www.orthomcl.org/orthomcl/). The resulting output files were screened for groups containing reference RFLs (Fujii et al., 2011).

In total, 633 RFLs were identified in the 34 cereal data sets by OrthoMCI analysis (see Table of FIGS. 1A and 1B). In addition, WGS data sets of 44 sorghum accessions including landraces and wild relatives (Mace et al., 2013) were analyzed and 517 additional RFL sequences were identified and included in the study (see Table of FIGS. 1A and B).

Example 2: Identification of Full Length RFL PPR Genes Potentially Involved in Fertility Restoration of *T. timopheevii* CMS in Wheat by Targeted Capture of RFL Genes A. Selection of Germplasm Accessions:

Six wheat accessions were identified as potential restorer lines of *Timopheevii*-type CMS (T-CMS) derived from the interspecific cross between *Triticum timopheevii* and *Triticum aestivum*.

The first accession is a wheat-rye addition line, "Wheat-Rye-6R", wherein the Rf gene was mapped on the additional long arm of 6R chromosome of rye *Secale cereale* (Curtis and Lukaszewski, 1993). Four other wheat accessions are characterized by the presence of at least one of the mapped restorer genes in wheat: Rf1, Rf3 and Rf7. The commercial variety, Primepii, carries the Rf3 gene, and three Limagrain lines R197, R0934F and R0932E respectively carry both Rf1 and Rf7 genes, Rf3 or Rf1.

The sixth accession, named Anapurna, is a maintainer line not able to restore T-CMS and carries no known Rf genes. Anapurna is considered as the negative control in this experiment. In addition, a *T. timopheevii* line was included in the study as it is a fertile line expected to harbor more than one Rf gene able to restore T-type CMS (Wilson and Ross, 1962). To some extent, this line is considered as a positive control in this experiment.

All six accessions were verified in regard to their restorer status by genetic analysis.

Northern blot analysis was performed with restorer and sterile accessions using an orf256-specific probe (FIG. 2A). Orf256 was previously identified as a gene specific to the *T. timopheevii* mitochondrial genome (Rathburn and Hedgcoth, 1991; Song and Hedgcoth, 1994). The sequence from −228 to +33 of orf256 (numbering relative to the start codon) is identical to the homologous region of the coxI gene (encoding subunit 1 of mitochondrial complex IV) in *T. aestivum*, whereas the rest of orf256, including the 3' flanking region, is unrelated to coxI (FIG. 2A). Different patterns of orf256 transcript processing in the fertile *T. timopheevii* line and fertile restorer lines carrying the *T. timopheevii* cytoplasm were observed when compared to the sterile CMS line pattern which is coherent with the genetic analysis (FIG. 2B). The different processing patterns are consistent with (but not conclusive proof that) orf256 is involved in causing CMS.

B. Bait Design and RFL-Capture from Different Wheat Genotypes:

The 1188 RFL PPR sequences identified by our bioinformatics analysis underwent a pre-treatment process that included masking of the target sequences against wheat mitochondrial and chloroplastic genome sequences (accessions NC_007579.1 and AB042240) as well as repeated elements of wheat genome. The masked target sequences were used for capture probe design. Briefly, probes were designed to cover the target sequences with a frequency masking algorithm intended to rule out probes that match with high copy number sequences in the targeted genome(s). The final probes were synthetized as a probe pool.

Seeds of each accession were sown and plantlets were grown in etiolated conditions. After DNA extraction, Illumina libraries (referred to as NGS libraries) were prepared from DNA fragments around 600 bp with the KAPA Biosystems chemistry according to the manufacturer's recommendations.

The NGS libraries were then specifically enriched in RFL sequences using the probe pool and a capture protocol. The efficiency of the capture was confirmed by a specific qPCR assay and ultimately libraries were pooled and sequenced in paired-end mode with 300 nt read length on a MiSeq platform.

C. Assembly of Full-Length Gene Sequences Encoding RFL Proteins and Identification of Putative Orthologous Groups:

Sequence reads from the RFL capture experiment were assembled into full-length contigs spanning one or more sequences encoding RFL proteins as described below. Overlapping paired reads were merged into a single sequence using bbmerge from the bbmap package (https://sourceforge.net/projects/bbmap/) with the parameters qtrim2=t trimq=10,15,20 minq=12 mininsert=150. Read pairs that could not be merged were discarded. The merged reads were downsampled to 300,000 reads using reformat.sh in the bbmap package (samplereadstarget=300000). The merged and downsampled reads were assembled with Geneious 8 (set to Medium Sensitivity/Fast) (http://www.geneious.com/). Finally, contigs composed of more than 100 merged reads were retained for further analysis, with most of these composed of over 1000 reads. In this way, a total of 1457 contigs were generated (Table 6).

Approximately 220 contigs were obtained from each accession, except for *Triticum timopheevii* for which only 138 contigs were assembled. This is consistent with the tetraploid nature of the *Triticum timopheevii* genome. The consistency of the results indicates that the RFL-capture experiment was, a priori, comprehensive.

TABLE 6

Number of RFL contigs and ORFs identified per accession and number of orthologous groups to which the ORFs were assigned with CD-hit.

| Accession name | Number of assembled contigs composed of >100 reads | Number of identified RFL ORFs >210 aa* | Number of orthologous groups with at least one RFL from the accession | Number of RFL ORFs >350 aa assigned to orthologous groups |
|---|---|---|---|---|
| Anapurna | 211 | 221 | 202 | 156 |
| Primepii | 226 | 234 | 215 | 162 |
| R197 | 219 | 241 | 219 | 174 |
| R0932E | 221 | 245 | 221 | 183 |
| R0934F | 223 | 237 | 215 | 174 |
| *Triticum timopheevi* | 138 | 143 | 129 | 114 |
| Wheat-Rye-6R | 219 | 233 | 212 | 163 |
| TOTAL | 1457 | 1554 | 397 (non-redundant) | 1254 |

Sequences encoding RFL proteins were identified within these contigs as follows.

Open reading frames (ORFs) within the contigs were identified with getorf from the EMBOSS package (Rice et al. 2000) using the parameters-minsize 630-find 0-reverse true. Thus only ORFs longer than 210 amino acids were used for further analysis. In total, 1554 ORFs were identified across the seven accessions (Table 6). The number of ORFs per accession ranged from 143 ORFs in *T. timopheevii* to 245 in R0934F (Table 6). The ORFs were further analyzed using hmmsearch (with parameters -E 0.1 --domE 100) from the HMMER package (v3.1b1) to detect PPR motifs using the hidden Markov models developed by Cheng et al. (2016) and the post-processing steps described in the same paper. Finally, to identify putatively orthologous RFL sequences across all seven accessions, the 1554 RFL ORFs were clustered using CD-hit (settings -c 0.96 -n 5 -G 0 -d 0 -AS 60 -A 105 -g 1). Across all accessions, 397 non-redundant RFL clusters representing putatively orthologous groups were obtained (Table 6). We define an orthologous RFL group as a set of at least one RFL ORF from at least one accession and wherein, if at least two sequences are present, these sequences share at least 96% sequence identity over the alignment length. Some highly conserved RFL genes are present in all seven accessions, others are found in only a subset of the accessions, or in a single accession. In most cases, each orthologous RFL group contains only one RFL protein from each accession.

Table 7 below is showing the different RFL groups, the corresponding ORF names and the corresponding protein sequence number and DNA encoding protein sequence number.

However, we found that genes encoding RFL-PPR proteins are often inactivated by indels creating frameshifts that break the contiguity of the ORFs, resulting in two shorter ORFs corresponding to a single longer ORF in another accession. In these cases, both shorter ORFs could be within the same orthologous group. In our analysis, only ORF encoding more than 350 amino acids were considered as possibly functional. This threshold was used as it corresponds to 10 PPR motifs (each of 35 amino acids), and all known active Rf proteins contain at least this number of motifs (usually 15-20).

Finally, a set of 397 orthologous RFL groups were identified and numbered from 1 to 397 (see Table 7 below).

TABLE 7

| RFL-Name | Name | SEQID-PRT1 | SEQID-DNA |
|---|---|---|---|
| RFL 1 | R0932E.300k_Assembly_Contig_60_2 | 1 | 1555 |
| RFL 1 | R197.300k_Assembly_Contig_73_2 | 2 | 1556 |
| RFL 2 | R0934F.300k_Assembly_Contig_11_2 | 3 | 1557 |
| RFL 2 | Anapurna.300k_Assembly_Contig_47_1 | 4 | 1558 |
| RFL 2 | Primepii.300k_Assembly_Contig_16_2 | 5 | 1559 |
| RFL 2 | R0932E.300k_Assembly_Contig_39_1 | 6 | 1560 |
| RFL 2 | R197.300k_Assembly_Contig_31_1 | 7 | 1561 |
| RFL 2 | Wheat-Rye-6R.300k_Assembly_Contig_13_1 | 8 | 1562 |
| RFL 3 | R0934F.300k_Assembly_Contig_34_2 | 9 | 1563 |
| RFL 3 | R0932E.300k_Assembly_Contig_41_1 | 10 | 1564 |
| RFL 3 | Wheat-Rye-6R.300k_Assembly_Contig_44_1 | 11 | 1565 |
| RFL 3 | Primepii.300k_Assembly_Contig_27_2 | 12 | 1566 |
| RFL 3 | R197.300k_Assembly_Contig_34_1 | 13 | 1567 |
| RFL 3 | Anapurna.300k_Assembly_Contig_21_1 | 14 | 1568 |
| RFL 4 | R197.300k_Assembly_Contig_38_2 | 15 | 1569 |
| RFL 4 | Anapurna.300k_Assembly_Contig_48_2 | 16 | 1570 |
| RFL 4 | Primepii.300k_Assembly_Contig_39_2 | 17 | 1571 |
| RFL 4 | R0932E.300k_Assembly_Contig_47_1 | 18 | 1572 |
| RFL 4 | R0934F.300k_Assembly_Contig_44_1 | 19 | 1573 |
| RFL 4 | Wheat-Rye-6R.300k_Assembly_Contig_32_2 | 20 | 1574 |
| RFL 4 | Triticum-timopheevii.300k_Assembly_Contig_19_2 | 21 | 1575 |
| RFL 5 | Primepii.300k_Assembly_Contig_9_3 | 22 | 1576 |
| RFL 5 | R0934F.300k_Assembly_Contig_7_3 | 23 | 1577 |
| RFL 5 | Anapurna.300k_Assembly_Contig_15_3 | 24 | 1578 |
| RFL 5 | R197.300k_Assembly_Contig_12_3 | 25 | 1579 |
| RFL 5 | R0932E.300k_Assembly_Contig_11_2 | 26 | 1580 |
| RFL 5 | Wheat-Rye-6R.300k_Assembly_Contig_9_2 | 27 | 1581 |
| RFL 5 | Triticum-timopheevii.300k_Assembly_Contig_9_2 | 28 | 1582 |
| RFL 6 | Wheat-Rye-6R.300k_Assembly_Contig_99_1 | 29 | 1583 |
| RFL 6 | Primepii.300k_Assembly_Contig_109_1 | 30 | 1584 |
| RFL 6 | Anapurna.300k_Assembly_Contig_99_2 | 31 | 1585 |
| RFL 6 | Anapurna.300k_Assembly_Contig_99_1 | 32 | 1586 |
| RFL 7 | Anapurna.300k_Assembly_Contig_82_1 | 33 | 1587 |
| RFL 7 | Primepii.300k_Assembly_Contig_25_1 | 34 | 1588 |
| RFL 7 | R0934F.300k_Assembly_Contig_86_1 | 35 | 1589 |
| RFL 7 | R197.300k_Assembly_Contig_11_1 | 36 | 1590 |
| RFL 7 | R0932E.300k_Assembly_Contig_61_1 | 37 | 1591 |
| RFL 7 | Wheat-Rye-6R.300k_Assembly_Contig_34_1 | 38 | 1592 |
| RFL 8 | R0932E.300k_Assembly_Contig_85_1 | 39 | 1593 |
| RFL 8 | Wheat-Rye-6R.300k_Assembly_Contig_79_2 | 40 | 1594 |
| RFL 8 | R0934F.300k_Assembly_Contig_87_2 | 41 | 1595 |
| RFL 8 | Primepii.300k_Assembly_Contig_64_1 | 42 | 1596 |
| RFL 8 | R197.300k_Assembly_Contig_71_2 | 43 | 1597 |
| RFL 8 | Anapurna.300k_Assembly_Contig_54_2 | 44 | 1598 |
| RFL 9 | R0932E.300k_Assembly_Contig_66_1 | 45 | 1599 |
| RFL 9 | Wheat-Rye-6R.300k_Assembly_Contig_69_1 | 46 | 1600 |
| RFL 9 | Primepii.300k_Assembly_Contig_59_1 | 47 | 1601 |
| RFL 9 | R197.300k_Assembly_Contig_51_1 | 48 | 1602 |
| RFL 9 | R0934F.300k_Assembly_Contig_89_1 | 49 | 1603 |
| RFL 9 | Anapurna.300k_Assembly_Contig_66_1 | 50 | 1604 |
| RFL 10 | Primepii.300k_Assembly_Contig_62_2 | 51 | 1605 |
| RFL 10 | Anapurna.300k_Assembly_Contig_179_1 | 52 | 1606 |
| RFL 10 | Anapurna.300k_Assembly_Contig_70_1 | 53 | 1607 |
| RFL 10 | R0932E.300k_Assembly_Contig_34_2 | 54 | 1608 |
| RFL 10 | Primepii.300k_Assembly_Contig_191_1 | 55 | 1609 |
| RFL 10 | R197.300k_Assembly_Contig_189_1 | 56 | 1610 |

TABLE 7-continued

| RFL-Name | Name | SEQID-PRT1 | SEQID-DNA |
|---|---|---|---|
| RFL 10 | Triticum-timopheevii.300k_Assembly_Contig_13_1 | 57 | 1611 |
| RFL 10 | R197.300k_Assembly_Contig_64_1 | 58 | 1612 |
| RFL 10 | Wheat-Rye-6R.300k_Assembly_Contig_62_2 | 59 | 1613 |
| RFL 10 | Wheat-Rye-6R.300k_Assembly_Contig_190_1 | 60 | 1614 |
| RFL 10 | R0934F.300k_Assembly_Contig_29_1 | 61 | 1615 |
| RFL 11 | Anapurna.300k_Assembly_Contig_14_2 | 62 | 1616 |
| RFL 11 | R0934F.300k_Assembly_Contig_14_2 | 63 | 1617 |
| RFL 11 | R0934F.300k_Assembly_Contig_14_1 | 64 | 1618 |
| RFL 11 | Triticum-timopheevii.300k_Assembly_Contig_22_1 | 65 | 1619 |
| RFL 11 | Primepii.300k_Assembly_Contig_38_2 | 66 | 1620 |
| RFL 11 | Triticum-timopheevii.300k_Assembly_Contig_22_2 | 67 | 1621 |
| RFL 11 | R197.300k_Assembly_Contig_33_1 | 68 | 1622 |
| RFL 11 | R0932E.300k_Assembly_Contig_27_2 | 69 | 1623 |
| RFL 11 | R197.300k_Assembly_Contig_33_2 | 70 | 1624 |
| RFL 11 | R0932E.300k_Assembly_Contig_27_1 | 71 | 1625 |
| RFL 11 | Wheat-Rye-6R.300k_Assembly_Contig_12_2 | 72 | 1626 |
| RFL 12 | R197.300k_Assembly_Contig_119_1 | 73 | 1627 |
| RFL 12 | Wheat-Rye-6R.300k_Assembly_Contig_115_1 | 74 | 1628 |
| RFL 12 | R0932E.300k_Assembly_Contig_120_2 | 75 | 1629 |
| RFL 13 | Anapurna.300k_Assembly_Contig_8_3 | 76 | 1630 |
| RFL 13 | Primepii.300k_Assembly_Contig_8_2 | 77 | 1631 |
| RFL 13 | R0932E.300k_Assembly_Contig_8_2 | 78 | 1632 |
| RFL 13 | R197.300k_Assembly_Contig_25_2 | 79 | 1633 |
| RFL 13 | Wheat-Rye-6R.300k_Assembly_Contig_21_2 | 80 | 1634 |
| RFL 13 | R0934F.300k_Assembly_Contig_18_2 | 81 | 1635 |
| RFL 14 | R0932E.300k_Assembly_Contig_24_1 | 82 | 1636 |
| RFL 14 | R0934F.300k_Assembly_Contig_10_1 | 83 | 1637 |
| RFL 14 | Wheat-Rye-6R.300k_Assembly_Contig_26_1 | 84 | 1638 |
| RFL 14 | R197.300k_Assembly_Contig_23_1 | 85 | 1639 |
| RFL 14 | Primepii.300k_Assembly_Contig_11_1 | 86 | 1640 |
| RFL 14 | Anapurna.300k_Assembly_Contig_13_1 | 87 | 1641 |
| RFL 15 | R197.300k_Assembly_Contig_29_1 | 88 | 1642 |
| RFL 15 | Anapurna.300k_Assembly_Contig_28_1 | 89 | 1643 |
| RFL 15 | R0934F.300k_Assembly_Contig_20_1 | 90 | 1644 |
| RFL 15 | Triticum-timopheevii.300k_Assembly_Contig_11_2 | 91 | 1645 |
| RFL 15 | R0932E.300k_Assembly_Contig_38_1 | 92 | 1646 |
| RFL 15 | Wheat-Rye-6R.300k_Assembly_Contig_6_1 | 93 | 1647 |
| RFL 15 | Primepii.300k_Assembly_Contig_22_1 | 94 | 1648 |
| RFL 16 | Primepii.300k_Assembly_Contig_23_2 | 95 | 1649 |
| RFL 16 | R197.300k_Assembly_Contig_43_2 | 96 | 1650 |
| RFL 16 | Wheat-Rye-6R.300k_Assembly_Contig_11_2 | 97 | 1651 |
| RFL 16 | Anapurna.300k_Assembly_Contig_10_2 | 98 | 1652 |
| RFL 16 | R0932E.300k_Assembly_Contig_18_2 | 99 | 1653 |
| RFL 16 | R0934F.300k_Assembly_Contig_15_2 | 100 | 1654 |
| RFL 17 | Triticum-timopheevii.300k_Assembly_Contig_7_1 | 101 | 1655 |
| RFL 17 | R197.300k_Assembly_Contig_58_1 | 102 | 1656 |
| RFL 17 | Wheat-Rye-6R.300k_Assembly_Contig_59_1 | 103 | 1657 |
| RFL 17 | R0934F.300k_Assembly_Contig_51_1 | 104 | 1658 |
| RFL 17 | Triticum-timopheevii.300k_Assembly_Contig_29_2 | 105 | 1659 |
| RFL 18 | R0934F.300k_Assembly_Contig_25_2 | 106 | 1660 |
| RFL 18 | R0932E.300k_Assembly_Contig_21_2 | 107 | 1661 |
| RFL 18 | R197.300k_Assembly_Contig_14_2 | 108 | 1662 |
| RFL 18 | Anapurna.300k_Assembly_Contig_6_2 | 109 | 1663 |
| RFL 18 | Triticum-timopheevii.300k_Assembly_Contig_16_3 | 110 | 1664 |
| RFL 18 | Primepii.300k_Assembly_Contig_20_2 | 111 | 1665 |
| RFL 18 | Wheat-Rye-6R.300k_Assembly_Contig_8_2 | 112 | 1666 |
| RFL 19 | Anapurna.300k_Assembly_Contig_68_1 | 113 | 1667 |
| RFL 20 | Triticum-timopheevii.300k_Assembly_Contig_47_1 | 114 | 1668 |
| RFL 21 | R197.300k_Assembly_Contig_18_1 | 115 | 1669 |
| RFL 21 | Anapurna.300k_Assembly_Contig_16_1 | 116 | 1670 |
| RFL 21 | R0932E.300k_Assembly_Contig_58_1 | 117 | 1671 |
| RFL 21 | Wheat-Rye-6R.300k_Assembly_Contig_23_3 | 118 | 1672 |
| RFL 21 | Wheat-Rye-6R.300k_Assembly_Contig_23_2 | 119 | 1673 |
| RFL 21 | Primepii.300k_Assembly_Contig_42_2 | 120 | 1674 |
| RFL 21 | R0934F.300k_Assembly_Contig_28_3 | 121 | 1675 |
| RFL 21 | Primepii.300k_Assembly_Contig_42_3 | 122 | 1676 |
| RFL 21 | R0934F.300k_Assembly_Contig_28_2 | 123 | 1677 |
| RFL 22 | Primepii.300k_Assembly_Contig_63_1 | 124 | 1678 |
| RFL 22 | R0934F.300k_Assembly_Contig_61_1 | 125 | 1679 |
| RFL 23 | R0934F.300k_Assembly_Contig_46_2 | 126 | 1680 |

TABLE 7-continued

| RFL-Name | Name | SEQID-PRT1 | SEQID-DNA |
|---|---|---|---|
| RFL 23 | Wheat-Rye-6R.300k_Assembly_Contig_30_1 | 127 | 1681 |
| RFL 23 | R197.300k_Assembly_Contig_15_3 | 128 | 1682 |
| RFL 23 | R0932E.300k_Assembly_Contig_40_1 | 129 | 1683 |
| RFL 23 | R0934F.300k_Assembly_Contig_46_1 | 130 | 1684 |
| RFL 23 | R197.300k_Assembly_Contig_15_2 | 131 | 1685 |
| RFL 23 | Anapurna.300k_Assembly_Contig_42_1 | 132 | 1686 |
| RFL 23 | Primepii.300k_Assembly_Contig_14_2 | 133 | 1687 |
| RFL 24 | Anapurna.300k_Assembly_Contig_17_1 | 134 | 1688 |
| RFL 24 | R0934F.300k_Assembly_Contig_22_1 | 135 | 1689 |
| RFL 24 | R0932E.300k_Assembly_Contig_44_1 | 136 | 1690 |
| RFL 24 | Primepii.300k_Assembly_Contig_46_1 | 137 | 1691 |
| RFL 24 | R197.300k_Assembly_Contig_30_1 | 138 | 1692 |
| RFL 24 | Wheat-Rye-6R.300k_Assembly_Contig_40_1 | 139 | 1693 |
| RFL 25 | R197.300k_Assembly_Contig_92_2 | 140 | 1694 |
| RFL 25 | Wheat-Rye-6R.300k_Assembly_Contig_109_2 | 141 | 1695 |
| RFL 26 | Anapurna.300k_Assembly_Contig_38_1 | 142 | 1696 |
| RFL 26 | Wheat-Rye-6R.300k_Assembly_Contig_41_1 | 143 | 1697 |
| RFL 27 | Triticum-timopheevii.300k_Assembly_Contig_63_3 | 144 | 1698 |
| RFL 28 | R0932E.300k_Assembly_Contig_23_2 | 145 | 1699 |
| RFL 28 | R0932E.300k_Assembly_Contig_23_3 | 146 | 1700 |
| RFL 28 | Primepii.300k_Assembly_Contig_13_1 | 147 | 1701 |
| RFL 28 | R197.300k_Assembly_Contig_10_3 | 148 | 1702 |
| RFL 28 | R197.300k_Assembly_Contig_10_2 | 149 | 1703 |
| RFL 28 | R0934F.300k_Assembly_Contig_17_1 | 150 | 1704 |
| RFL 28 | Anapurna.300k_Assembly_Contig_2_3 | 151 | 1705 |
| RFL 28 | Wheat-Rye-6R.300k_Assembly_Contig_7_3 | 152 | 1706 |
| RFL 28 | Anapurna.300k_Assembly_Contig_2_2 | 153 | 1707 |
| RFL 28 | Wheat-Rye-6R.300k_Assembly_Contig_7_2 | 154 | 1708 |
| RFL 29 | Wheat-Rye-6R.300k_Assembly_Contig_77_2 | 155 | 1709 |
| RFL 29 | R0934F.300k_Assembly_Contig_78_1 | 156 | 1710 |
| RFL 29 | Wheat-Rye-6R.300k_Assembly_Contig_77_1 | 157 | 1711 |
| RFL 29 | Primepii.300k_Assembly_Contig_67_1 | 158 | 1712 |
| RFL 30 | Primepii.300k_Assembly_Contig_91_1 | 159 | 1713 |
| RFL 30 | R0934F.300k_Assembly_Contig_64_1 | 160 | 1714 |
| RFL 30 | R0932E.300k_Assembly_Contig_110_1 | 161 | 1715 |
| RFL 31 | Triticum-timopheevii.300k_Assembly_Contig_14_1 | 162 | 1716 |
| RFL 32 | Triticum-timopheevii.300k_Assembly_Contig_6_2 | 163 | 1717 |
| RFL 32 | Primepii.300k_Assembly_Contig_6_2 | 164 | 1718 |
| RFL 32 | R0934F.300k_Assembly_Contig_31_2 | 165 | 1719 |
| RFL 32 | R197.300k_Assembly_Contig_7_2 | 166 | 1720 |
| RFL 32 | Anapurna.300k_Assembly_Contig_31_2 | 167 | 1721 |
| RFL 32 | Wheat-Rye-6R.300k_Assembly_Contig_5_2 | 168 | 1722 |
| RFL 32 | R0932E.300k_Assembly_Contig_29_2 | 169 | 1723 |
| RFL 33 | Triticum-timopheevii.300k_Assembly_Contig_8_1 | 170 | 1724 |
| RFL 33 | Anapurna.300k_Assembly_Contig_5_2 | 171 | 1725 |
| RFL 33 | R197.300k_Assembly_Contig_6_3 | 172 | 1726 |
| RFL 33 | Wheat-Rye-6R.300k_Assembly_Contig_25_1 | 173 | 1727 |
| RFL 33 | R0932E.300k_Assembly_Contig_19_1 | 174 | 1728 |
| RFL 33 | Primepii.300k_Assembly_Contig_21_2 | 175 | 1729 |
| RFL 33 | R0934F.300k_Assembly_Contig_104_1 | 176 | 1730 |
| RFL 34 | R0932E.300k_Assembly_Contig_5_1 | 177 | 1731 |
| RFL 34 | R0932E.300k_Assembly_Contig_2_4 | 178 | 1732 |
| RFL 35 | Triticum-timopheevii.300k_Assembly_Contig_21_2 | 179 | 1733 |
| RFL 36 | Triticum-timopheevii.300k_Assembly_Contig_20_2 | 180 | 1734 |
| RFL 37 | Anapurna.300k_Assembly_Contig_37_2 | 181 | 1735 |
| RFL 37 | Wheat-Rye-6R.300k_Assembly_Contig_19_2 | 182 | 1736 |
| RFL 37 | R0932E.300k_Assembly_Contig_12_2 | 183 | 1737 |
| RFL 37 | R197.300k_Assembly_Contig_20_2 | 184 | 1738 |
| RFL 37 | R0934F.300k_Assembly_Contig_37_2 | 185 | 1739 |
| RFL 37 | Primepii.300k_Assembly_Contig_10_2 | 186 | 1740 |
| RFL 38 | Triticum-timopheevii.300k_Assembly_Contig_43_2 | 187 | 1741 |
| RFL 39 | R0932E.300k_Assembly_Contig_53_2 | 188 | 1742 |
| RFL 39 | Anapurna.300k_Assembly_Contig_29_2 | 189 | 1743 |
| RFL 39 | R0932E.300k_Assembly_Contig_22_1 | 190 | 1744 |
| RFL 39 | Wheat-Rye-6R.300k_Assembly_Contig_28_2 | 191 | 1745 |
| RFL 39 | Triticum-timopheevii.300k_Assembly_Contig_25_2 | 192 | 1746 |
| RFL 39 | Wheat-Rye-6R.300k_Assembly_Contig_15_1 | 193 | 1747 |
| RFL 39 | R0934F.300k_Assembly_Contig_27_1 | 194 | 1748 |
| RFL 39 | R0934F.300k_Assembly_Contig_26_2 | 195 | 1749 |
| RFL 39 | Primepii.300k_Assembly_Contig_40_2 | 196 | 1750 |

TABLE 7-continued

| RFL-Name | Name | SEQID-PRT1 | SEQID-DNA |
|---|---|---|---|
| RFL 39 | Primepii.300k_Assembly_Contig_30_1 | 197 | 1751 |
| RFL 39 | R197.300k_Assembly_Contig_36_2 | 198 | 1752 |
| RFL 39 | R197.300k_Assembly_Contig_27_1 | 199 | 1753 |
| RFL 39 | Anapurna.300k_Assembly_Contig_43_1 | 200 | 1754 |
| RFL 40 | R0934F.300k_Assembly_Contig_12_1 | 201 | 1755 |
| RFL 40 | Primepii.300k_Assembly_Contig_18_1 | 202 | 1756 |
| RFL 40 | Triticum-timopheevii.300k_Assembly_Contig_5_1 | 203 | 1757 |
| RFL 40 | R0932E.300k_Assembly_Contig_7_1 | 204 | 1758 |
| RFL 40 | Anapurna.300k_Assembly_Contig_20_1 | 205 | 1759 |
| RFL 40 | R197.300k_Assembly_Contig_32_1 | 206 | 1760 |
| RFL 41 | R0934F.300k_Assembly_Contig_24_2 | 207 | 1761 |
| RFL 41 | Wheat-Rye-6R.300k_Assembly_Contig_45_2 | 208 | 1762 |
| RFL 41 | Anapurna.300k_Assembly_Contig_39_2 | 209 | 1763 |
| RFL 41 | R0932E.300k_Assembly_Contig_56_2 | 210 | 1764 |
| RFL 41 | Primepii.300k_Assembly_Contig_47_2 | 211 | 1765 |
| RFL 41 | R197.300k_Assembly_Contig_40_2 | 212 | 1766 |
| RFL 42 | Triticum-timopheevii.300k_Assembly_Contig_10_3 | 213 | 1767 |
| RFL 43 | R0934F.300k_Assembly_Contig_8_1 | 214 | 1768 |
| RFL 43 | R0932E.300k_Assembly_Contig_13_1 | 215 | 1769 |
| RFL 43 | Triticum-timopheevii.300k_Assembly_Contig_12_2 | 216 | 1770 |
| RFL 43 | R197.300k_Assembly_Contig_22_1 | 217 | 1771 |
| RFL 43 | Primepii.300k_Assembly_Contig_31_1 | 218 | 1772 |
| RFL 43 | Anapurna.300k_Assembly_Contig_23_1 | 219 | 1773 |
| RFL 43 | Wheat-Rye-6R.300k_Assembly_Contig_10_1 | 220 | 1774 |
| RFL 44 | R0932E.300k_Assembly_Contig_32_1 | 221 | 1775 |
| RFL 44 | Primepii.300k_Assembly_Contig_7_1 | 222 | 1776 |
| RFL 44 | Anapurna.300k_Assembly_Contig_33_1 | 223 | 1777 |
| RFL 45 | R0932E.300k_Assembly_Contig_73_2 | 224 | 1778 |
| RFL 45 | R197.300k_Assembly_Contig_70_2 | 225 | 1779 |
| RFL 45 | Wheat-Rye-6R.300k_Assembly_Contig_72_2 | 226 | 1780 |
| RFL 46 | Wheat-Rye-6R.300k_Assembly_Contig_35_1 | 227 | 1781 |
| RFL 47 | R0934F.300k_Assembly_Contig_57_2 | 228 | 1782 |
| RFL 47 | Wheat-Rye-6R.300k_Assembly_Contig_67_2 | 229 | 1783 |
| RFL 47 | Anapurna.300k_Assembly_Contig_85_2 | 230 | 1784 |
| RFL 47 | R0932E.300k_Assembly_Contig_71_2 | 231 | 1785 |
| RFL 47 | R197.300k_Assembly_Contig_62_2 | 232 | 1786 |
| RFL 47 | Primepii.300k_Assembly_Contig_86_3 | 233 | 1787 |
| RFL 48 | Primepii.300k_Assembly_Contig_51_1 | 234 | 1788 |
| RFL 48 | R197.300k_Assembly_Contig_57_1 | 235 | 1789 |
| RFL 48 | Anapurna.300k_Assembly_Contig_74_1 | 236 | 1790 |
| RFL 48 | R0934F.300k_Assembly_Contig_71_1 | 237 | 1791 |
| RFL 48 | R0932E.300k_Assembly_Contig_72_1 | 238 | 1792 |
| RFL 48 | Wheat-Rye-6R.300k_Assembly_Contig_82_1 | 239 | 1793 |
| RFL 49 | R197.300k_Assembly_Contig_83_1 | 240 | 1794 |
| RFL 49 | R197.300k_Assembly_Contig_95_2 | 241 | 1795 |
| RFL 49 | Triticum-timopheevii.300k_Assembly_Contig_37_1 | 242 | 1796 |
| RFL 49 | Triticum-timopheevii.300k_Assembly_Contig_38_1 | 243 | 1797 |
| RFL 50 | Anapurna.300k_Assembly_Contig_24_2 | 244 | 1798 |
| RFL 50 | Primepii.300k_Assembly_Contig_24_2 | 245 | 1799 |
| RFL 50 | R0932E.300k_Assembly_Contig_25_2 | 246 | 1800 |
| RFL 50 | R197.300k_Assembly_Contig_21_2 | 247 | 1801 |
| RFL 50 | Wheat-Rye-6R.300k_Assembly_Contig_22_2 | 248 | 1802 |
| RFL 50 | R0934F.300k_Assembly_Contig_39_2 | 249 | 1803 |
| RFL 51 | Anapurna.300k_Assembly_Contig_35_2 | 250 | 1804 |
| RFL 51 | R0934F.300k_Assembly_Contig_5_4 | 251 | 1805 |
| RFL 51 | Primepii.300k_Assembly_Contig_17_3 | 252 | 1806 |
| RFL 51 | Anapurna.300k_Assembly_Contig_109_1 | 253 | 1807 |
| RFL 51 | Primepii.300k_Assembly_Contig_19_2 | 254 | 1808 |
| RFL 51 | R0932E.300k_Assembly_Contig_55_1 | 255 | 1809 |
| RFL 51 | Wheat-Rye-6R.300k_Assembly_Contig_2_1 | 256 | 1810 |
| RFL 51 | R0934F.300k_Assembly_Contig_55_2 | 257 | 1811 |
| RFL 51 | Triticum-timopheevii.300k_Assembly_Contig_4_2 | 258 | 1812 |
| RFL 51 | R197.300k_Assembly_Contig_46_2 | 259 | 1813 |
| RFL 51 | Wheat-Rye-6R.300k_Assembly_Contig_37_2 | 260 | 1814 |
| RFL 51 | Anapurna.300k_Assembly_Contig_106_1 | 261 | 1815 |
| RFL 51 | R197.300k_Assembly_Contig_5_3 | 262 | 1816 |
| RFL 51 | R0932E.300k_Assembly_Contig_6_2 | 263 | 1817 |
| RFL 52 | R197.300k_Assembly_Contig_37_1 | 264 | 1818 |
| RFL 52 | R197.300k_Assembly_Contig_37_2 | 265 | 1819 |
| RFL 52 | R0932E.300k_Assembly_Contig_45_1 | 266 | 1820 |
| RFL 52 | Wheat-Rye-6R.300k_Assembly_Contig_39_1 | 267 | 1821 |
| RFL 52 | Wheat-Rye-6R.300k_Assembly_Contig_39_2 | 268 | 1822 |

TABLE 7-continued

| RFL-Name | Name | SEQID-PRT1 | SEQID-DNA |
|---|---|---|---|
| RFL 52 | Primepii.300k_Assembly_Contig_49_1 | 269 | 1823 |
| RFL 52 | Anapurna.300k_Assembly_Contig_22_1 | 270 | 1824 |
| RFL 52 | R0934F.300k_Assembly_Contig_49_1 | 271 | 1825 |
| RFL 52 | R0934F.300k_Assembly_Contig_49_2 | 272 | 1826 |
| RFL 52 | Triticum-timopheevii.300k_Assembly_Contig_29_1 | 273 | 1827 |
| RFL 53 | R0934F.300k_Assembly_Contig_75_2 | 274 | 1828 |
| RFL 53 | R0932E.300k_Assembly_Contig_64_2 | 275 | 1829 |
| RFL 53 | Anapurna.300k_Assembly_Contig_72_2 | 276 | 1830 |
| RFL 53 | Primepii.300k_Assembly_Contig_57_2 | 277 | 1831 |
| RFL 53 | Triticum-timopheevii.300k_Assembly_Contig_55_3 | 278 | 1832 |
| RFL 54 | Wheat-Rye-6R.300k_Assembly_Contig_80_1 | 279 | 1833 |
| RFL 54 | R0932E.300k_Assembly_Contig_209_1 | 280 | 1834 |
| RFL 54 | Anapurna.300k_Assembly_Contig_77_1 | 281 | 1835 |
| RFL 55 | R0932E.300k_Assembly_Contig_54_1 | 282 | 1836 |
| RFL 55 | R197.300k_Assembly_Contig_39_1 | 283 | 1837 |
| RFL 55 | R0934F.300k_Assembly_Contig_54_1 | 284 | 1838 |
| RFL 55 | Anapurna.300k_Assembly_Contig_41_1 | 285 | 1839 |
| RFL 55 | Primepii.300k_Assembly_Contig_44_1 | 286 | 1840 |
| RFL 55 | Wheat-Rye-6R.300k_Assembly_Contig_31_1 | 287 | 1841 |
| RFL 56 | R197.300k_Assembly_Contig_86_1 | 288 | 1842 |
| RFL 56 | R0932E.300k_Assembly_Contig_74_1 | 289 | 1843 |
| RFL 56 | Triticum-timopheevii.300k_Assembly_Contig_39_1 | 290 | 1844 |
| RFL 58 | Wheat-Rye-6R.300k_Assembly_Contig_66_1 | 291 | 1845 |
| RFL 58 | Anapurna.300k_Assembly_Contig_12_1 | 292 | 1846 |
| RFL 59 | Triticum-timopheevii.300k_Assembly_Contig_60_1 | 293 | 1847 |
| RFL 59 | R197.300k_Assembly_Contig_115_1 | 294 | 1848 |
| RFL 59 | R0932E.300k_Assembly_Contig_161_1 | 295 | 1849 |
| RFL 59 | R0932E.300k_Assembly_Contig_48_1 | 296 | 1850 |
| RFL 60 | Primepii.300k_Assembly_Contig_94_1 | 297 | 1851 |
| RFL 60 | R197.300k_Assembly_Contig_95_1 | 298 | 1852 |
| RFL 60 | R0934F.300k_Assembly_Contig_73_2 | 299 | 1853 |
| RFL 60 | Wheat-Rye-6R.300k_Assembly_Contig_48_2 | 300 | 1854 |
| RFL 61 | Triticum-timopheevii.300k_Assembly_Contig_48_1 | 301 | 1855 |
| RFL 62 | R0934F.300k_Assembly_Contig_138_1 | 302 | 1856 |
| RFL 63 | R197.300k_Assembly_Contig_84_1 | 303 | 1857 |
| RFL 63 | R197.300k_Assembly_Contig_84_2 | 304 | 1858 |
| RFL 63 | Triticum-timopheevii.300k_Assembly_Contig_34_1 | 305 | 1859 |
| RFL 64 | Primepii.300k_Assembly_Contig_50_1 | 306 | 1860 |
| RFL 64 | Wheat-Rye-6R.300k_Assembly_Contig_54_1 | 307 | 1861 |
| RFL 64 | R0934F.300k_Assembly_Contig_45_1 | 308 | 1862 |
| RFL 64 | Anapurna.300k_Assembly_Contig_61_1 | 309 | 1863 |
| RFL 64 | R197.300k_Assembly_Contig_42_1 | 310 | 1864 |
| RFL 64 | R0932E.300k_Assembly_Contig_59_1 | 311 | 1865 |
| RFL 65 | Triticum-timopheevii.300k_Assembly_Contig_42_2 | 312 | 1866 |
| RFL 66 | Triticum-timopheevii.300k_Assembly_Contig_27_1 | 313 | 1867 |
| RFL 66 | Triticum-timopheevii.300k_Assembly_Contig_80_1 | 314 | 1868 |
| RFL 67 | Primepii.300k_Assembly_Contig_213_1 | 315 | 1869 |
| RFL 67 | Primepii.300k_Assembly_Contig_80_2 | 316 | 1870 |
| RFL 67 | Primepii.300k_Assembly_Contig_80_1 | 317 | 1871 |
| RFL 67 | R0934F.300k_Assembly_Contig_111_2 | 318 | 1872 |
| RFL 67 | Primepii.300k_Assembly_Contig_2_1 | 319 | 1873 |
| RFL 67 | R0934F.300k_Assembly_Contig_111_1 | 320 | 1874 |
| RFL 67 | R0934F.300k_Assembly_Contig_4_1 | 321 | 1875 |
| RFL 68 | Wheat-Rye-6R.300k_Assembly_Contig_53_1 | 322 | 1876 |
| RFL 68 | R0932E.300k_Assembly_Contig_68_1 | 323 | 1877 |
| RFL 68 | Wheat-Rye-6R.300k_Assembly_Contig_53_3 | 324 | 1878 |
| RFL 68 | R197.300k_Assembly_Contig_19_1 | 325 | 1879 |
| RFL 68 | R0934F.300k_Assembly_Contig_66_1 | 326 | 1880 |
| RFL 68 | Triticum-timopheevii.300k_Assembly_Contig_33_1 | 327 | 1881 |
| RFL 68 | Anapurna.300k_Assembly_Contig_71_1 | 328 | 1882 |
| RFL 68 | Anapurna.300k_Assembly_Contig_71_2 | 329 | 1883 |
| RFL 68 | Primepii.300k_Assembly_Contig_37_1 | 330 | 1884 |
| RFL 68 | R0932E.300k_Assembly_Contig_68_3 | 331 | 1885 |
| RFL 68 | R197.300k_Assembly_Contig_19_3 | 332 | 1886 |
| RFL 69 | Triticum-timopheevii.300k_Assembly_Contig_45_1 | 333 | 1887 |
| RFL 70 | R0934F.300k_Assembly_Contig_68_1 | 334 | 1888 |
| RFL 70 | R197.300k_Assembly_Contig_65_1 | 335 | 1889 |

TABLE 7-continued

| RFL-Name | Name | SEQID-PRT1 | SEQID-DNA |
|---|---|---|---|
| RFL 70 | R0932E.300k_Assembly_Contig_94_1 | 336 | 1890 |
| RFL 70 | Primepii.300k_Assembly_Contig_55_1 | 337 | 1891 |
| RFL 70 | Anapurna.300k_Assembly_Contig_111_1 | 338 | 1892 |
| RFL 70 | Wheat-Rye-6R.300k_Assembly_Contig_74_1 | 339 | 1893 |
| RFL 70 | Anapurna.300k_Assembly_Contig_98_1 | 340 | 1894 |
| RFL 71 | R0932E.300k_Assembly_Contig_114_1 | 341 | 1895 |
| RFL 72 | R0932E.300k_Assembly_Contig_98_1 | 342 | 1896 |
| RFL 73 | R0932E.300k_Assembly_Contig_89_2 | 343 | 1897 |
| RFL 73 | R197.300k_Assembly_Contig_78_2 | 344 | 1898 |
| RFL 73 | Triticum-timopheevii.300k_Assembly_Contig_31_2 | 345 | 1899 |
| RFL 74 | R197.300k_Assembly_Contig_194_1 | 346 | 1900 |
| RFL 74 | R0934F.300k_Assembly_Contig_36_2 | 347 | 1901 |
| RFL 74 | R0934F.300k_Assembly_Contig_150_2 | 348 | 1902 |
| RFL 74 | R0932E.300k_Assembly_Contig_185_1 | 349 | 1903 |
| RFL 74 | R0932E.300k_Assembly_Contig_201_1 | 350 | 1904 |
| RFL 74 | R0932E.300k_Assembly_Contig_92_1 | 351 | 1905 |
| RFL 74 | R197.300k_Assembly_Contig_179_1 | 352 | 1906 |
| RFL 74 | R0932E.300k_Assembly_Contig_83_1 | 353 | 1907 |
| RFL 74 | R197.300k_Assembly_Contig_4_1 | 354 | 1908 |
| RFL 74 | R0934F.300k_Assembly_Contig_126_1 | 355 | 1909 |
| RFL 75 | R0932E.300k_Assembly_Contig_88_1 | 356 | 1910 |
| RFL 77 | R0932E.300k_Assembly_Contig_214_2 | 357 | 1911 |
| RFL 78 | R0932E.300k_Assembly_Contig_112_1 | 358 | 1912 |
| RFL 79 | R0932E.300k_Assembly_Contig_103_1 | 359 | 1913 |
| RFL 79 | R0934F.300k_Assembly_Contig_80_1 | 360 | 1914 |
| RFL 79 | R197.300k_Assembly_Contig_120_1 | 361 | 1915 |
| RFL 79 | Triticum-timopheevii.300k_Assembly_Contig_57_1 | 362 | 1916 |
| RFL 80 | R197.300k_Assembly_Contig_59_1 | 363 | 1917 |
| RFL 81 | R0932E.300k_Assembly_Contig_4_1 | 364 | 1918 |
| RFL 81 | R0932E.300k_Assembly_Contig_199_1 | 365 | 1919 |
| RFL 82 | Triticum-timopheevii.300k_Assembly_Contig_64_2 | 366 | 1920 |
| RFL 82 | R0932E.300k_Assembly_Contig_123_2 | 367 | 1921 |
| RFL 83 | Primepii.300k_Assembly_Contig_52_1 | 368 | 1922 |
| RFL 83 | R0934F.300k_Assembly_Contig_43_1 | 369 | 1923 |
| RFL 83 | R0932E.300k_Assembly_Contig_46_1 | 370 | 1924 |
| RFL 83 | Anapurna.300k_Assembly_Contig_62_1 | 371 | 1925 |
| RFL 83 | R197.300k_Assembly_Contig_54_1 | 372 | 1926 |
| RFL 83 | Wheat-Rye-6R.300k_Assembly_Contig_60_1 | 373 | 1927 |
| RFL 84 | R0932E.300k_Assembly_Contig_116_1 | 374 | 1928 |
| RFL 85 | R197.300k_Assembly_Contig_80_3 | 375 | 1929 |
| RFL 85 | Triticum-timopheevii.300k_Assembly_Contig_36_3 | 376 | 1930 |
| RFL 85 | R197.300k_Assembly_Contig_80_2 | 377 | 1931 |
| RFL 87 | Wheat-Rye-6R.300k_Assembly_Contig_73_1 | 378 | 1932 |
| RFL 89 | Primepii.300k_Assembly_Contig_83_1 | 379 | 1933 |
| RFL 89 | Primepii.300k_Assembly_Contig_183_1 | 380 | 1934 |
| RFL 89 | R0934F.300k_Assembly_Contig_99_1 | 381 | 1935 |
| RFL 90 | Primepii.300k_Assembly_Contig_82_2 | 382 | 1936 |
| RFL 90 | Wheat-Rye-6R.300k_Assembly_Contig_65_2 | 383 | 1937 |
| RFL 90 | R0934F.300k_Assembly_Contig_63_1 | 384 | 1938 |
| RFL 90 | R197.300k_Assembly_Contig_66_2 | 385 | 1939 |
| RFL 90 | Anapurna.300k_Assembly_Contig_51_1 | 386 | 1940 |
| RFL 90 | R0932E.300k_Assembly_Contig_90_1 | 387 | 1941 |
| RFL 92 | Wheat-Rye-6R.300k_Assembly_Contig_55_2 | 388 | 1942 |
| RFL 92 | R197.300k_Assembly_Contig_47_2 | 389 | 1943 |
| RFL 92 | Triticum-timopheevii.300k_Assembly_Contig_30_2 | 390 | 1944 |
| RFL 92 | R0932E.300k_Assembly_Contig_43_2 | 391 | 1945 |
| RFL 92 | Triticum-timopheevii.300k_Assembly_Contig_30_3 | 392 | 1946 |
| RFL 92 | Anapurna.300k_Assembly_Contig_50_2 | 393 | 1947 |
| RFL 92 | R0934F.300k_Assembly_Contig_48_2 | 394 | 1948 |
| RFL 92 | Primepii.300k_Assembly_Contig_53_2 | 395 | 1949 |
| RFL 93 | R197.300k_Assembly_Contig_117_1 | 396 | 1950 |
| RFL 93 | R0932E.300k_Assembly_Contig_113_1 | 397 | 1951 |
| RFL 94 | Wheat-Rye-6R.300k_Assembly_Contig_41_2 | 398 | 1952 |
| RFL 94 | Anapurna.300k_Assembly_Contig_38_2 | 399 | 1953 |
| RFL 94 | R197.300k_Assembly_Contig_24_1 | 400 | 1954 |
| RFL 94 | R0934F.300k_Assembly_Contig_32_1 | 401 | 1955 |
| RFL 94 | R0932E.300k_Assembly_Contig_17_1 | 402 | 1956 |
| RFL 94 | Primepii.300k_Assembly_Contig_41_2 | 403 | 1957 |
| RFL 95 | Triticum-timopheevii.300k_Assembly_Contig_51_1 | 404 | 1958 |
| RFL 96 | Primepii.300k_Assembly_Contig_72_1 | 405 | 1959 |
| RFL 97 | Anapurna.300k_Assembly_Contig_92_2 | 406 | 1960 |

TABLE 7-continued

| RFL-Name | Name | SEQID-PRT1 | SEQID-DNA |
|---|---|---|---|
| RFL 97 | Anapurna.300k_Assembly_Contig_19_1 | 407 | 1961 |
| RFL 97 | Wheat-Rye-6R.300k_Assembly_Contig_103_2 | 408 | 1962 |
| RFL 97 | Wheat-Rye-6R.300k_Assembly_Contig_63_1 | 409 | 1963 |
| RFL 98 | R0932E.300k_Assembly_Contig_79_1 | 410 | 1964 |
| RFL 98 | Primepii.300k_Assembly_Contig_70_1 | 411 | 1965 |
| RFL 98 | R0934F.300k_Assembly_Contig_70_1 | 412 | 1966 |
| RFL 98 | R197.300k_Assembly_Contig_63_1 | 413 | 1967 |
| RFL 98 | Wheat-Rye-6R.300k_Assembly_Contig_71_1 | 414 | 1968 |
| RFL 99 | R0932E.300k_Assembly_Contig_15_2 | 415 | 1969 |
| RFL 99 | R0932E.300k_Assembly_Contig_153_2 | 416 | 1970 |
| RFL 100 | R197.300k_Assembly_Contig_94_1 | 417 | 1971 |
| RFL 100 | Wheat-Rye-6R.300k_Assembly_Contig_113_1 | 418 | 1972 |
| RFL 100 | R0932E.300k_Assembly_Contig_100_1 | 419 | 1973 |
| RFL 100 | Anapurna.300k_Assembly_Contig_113_1 | 420 | 1974 |
| RFL 101 | Anapurna.300k_Assembly_Contig_59_1 | 421 | 1975 |
| RFL 101 | Triticum-timopheevii.300k_Assembly_Contig_54_1 | 422 | 1976 |
| RFL 102 | Triticum-timopheevii.300k_Assembly_Contig_71_1 | 423 | 1977 |
| RFL 103 | Primepii.300k_Assembly_Contig_106_1 | 424 | 1978 |
| RFL 103 | Wheat-Rye-6R.300k_Assembly_Contig_98_1 | 425 | 1979 |
| RFL 103 | R197.300k_Assembly_Contig_79_1 | 426 | 1980 |
| RFL 104 | R0934F.300k_Assembly_Contig_69_1 | 427 | 1981 |
| RFL 104 | Triticum-timopheevii.300k_Assembly_Contig_35_1 | 428 | 1982 |
| RFL 104 | R0932E.300k_Assembly_Contig_82_1 | 429 | 1983 |
| RFL 104 | R197.300k_Assembly_Contig_72_1 | 430 | 1984 |
| RFL 105 | Primepii.300k_Assembly_Contig_85_1 | 431 | 1985 |
| RFL 106 | Wheat-Rye-6R.300k_Assembly_Contig_87_2 | 432 | 1986 |
| RFL 106 | Primepii.300k_Assembly_Contig_81_2 | 433 | 1987 |
| RFL 106 | Anapurna.300k_Assembly_Contig_80_1 | 434 | 1988 |
| RFL 106 | R0932E.300k_Assembly_Contig_76_1 | 435 | 1989 |
| RFL 106 | R197.300k_Assembly_Contig_67_1 | 436 | 1990 |
| RFL 106 | R0934F.300k_Assembly_Contig_103_2 | 437 | 1991 |
| RFL 107 | R0934F.300k_Assembly_Contig_117_1 | 438 | 1992 |
| RFL 107 | Triticum-timopheevii.300k_Assembly_Contig_69_1 | 439 | 1993 |
| RFL 108 | Wheat-Rye-6R.300k_Assembly_Contig_86_1 | 440 | 1994 |
| RFL 108 | R0932E.300k_Assembly_Contig_87_1 | 441 | 1995 |
| RFL 108 | R197.300k_Assembly_Contig_77_1 | 442 | 1996 |
| RFL 108 | Anapurna.300k_Assembly_Contig_78_1 | 443 | 1997 |
| RFL 108 | R0934F.300k_Assembly_Contig_115_1 | 444 | 1998 |
| RFL 109 | Triticum-timopheevii.300k_Assembly_Contig_78_2 | 445 | 1999 |
| RFL 110 | Triticum-timopheevii.300k_Assembly_Contig_15_2 | 446 | 2000 |
| RFL 111 | R0932E.300k_Assembly_Contig_78_1 | 447 | 2001 |
| RFL 111 | R0934F.300k_Assembly_Contig_23_1 | 448 | 2002 |
| RFL 111 | Anapurna.300k_Assembly_Contig_58_1 | 449 | 2003 |
| RFL 111 | R197.300k_Assembly_Contig_69_1 | 450 | 2004 |
| RFL 111 | Primepii.300k_Assembly_Contig_35_1 | 451 | 2005 |
| RFL 111 | Wheat-Rye-6R.300k_Assembly_Contig_83_1 | 452 | 2006 |
| RFL 112 | R0932E.300k_Assembly_Contig_20_1 | 453 | 2007 |
| RFL 112 | R197.300k_Assembly_Contig_17_1 | 454 | 2008 |
| RFL 112 | Wheat-Rye-6R.300k_Assembly_Contig_17_1 | 455 | 2009 |
| RFL 112 | Anapurna.300k_Assembly_Contig_4_1 | 456 | 2010 |
| RFL 112 | Primepii.300k_Assembly_Contig_12_1 | 457 | 2011 |
| RFL 112 | R0934F.300k_Assembly_Contig_6_1 | 458 | 2012 |
| RFL 113 | R0932E.300k_Assembly_Contig_216_1 | 459 | 2013 |
| RFL 113 | R0934F.300k_Assembly_Contig_202_1 | 460 | 2014 |
| RFL 113 | Primepii.300k_Assembly_Contig_92_1 | 461 | 2015 |
| RFL 113 | R197.300k_Assembly_Contig_98_1 | 462 | 2016 |
| RFL 114 | R0932E.300k_Assembly_Contig_86_1 | 463 | 2017 |
| RFL 115 | R0934F.300k_Assembly_Contig_128_1 | 464 | 2018 |
| RFL 115 | Triticum-timopheevii.300k_Assembly_Contig_74_1 | 465 | 2019 |
| RFL 116 | Triticum-timopheevii.300k_Assembly_Contig_44_2 | 466 | 2020 |
| RFL 118 | R197.300k_Assembly_Contig_75_1 | 467 | 2021 |
| RFL 118 | Wheat-Rye-6R.300k_Assembly_Contig_93_1 | 468 | 2022 |
| RFL 118 | Anapurna.300k_Assembly_Contig_87_1 | 469 | 2023 |
| RFL 119 | R197.300k_Assembly_Contig_1_1 | 470 | 2024 |
| RFL 119 | Wheat-Rye-6R.300k_Assembly_Contig_1_1 | 471 | 2025 |
| RFL 119 | Wheat-Rye-6R.300k_Assembly_Contig_194_1 | 472 | 2026 |
| RFL 119 | R0934F.300k_Assembly_Contig_2_1 | 473 | 2027 |
| RFL 119 | Primepii.300k_Assembly_Contig_1_1 | 474 | 2028 |
| RFL 119 | Anapurna.300k_Assembly_Contig_1_1 | 475 | 2029 |
| RFL 119 | R0932E.300k_Assembly_Contig_1_1 | 476 | 2030 |

TABLE 7-continued

| RFL-Name | Name | SEQID-PRT1 | SEQID-DNA |
|---|---|---|---|
| RFL 120 | Triticum-timopheevii.300k_Assembly_Contig_67_1 | 477 | 2031 |
| RFL 121 | R197.300k_Assembly_Contig_96_1 | 478 | 2032 |
| RFL 121 | R0932E.300k_Assembly_Contig_93_1 | 479 | 2033 |
| RFL 121 | Triticum-timopheevii.300k_Assembly_Contig_70_1 | 480 | 2034 |
| RFL 121 | R0934F.300k_Assembly_Contig_102_1 | 481 | 2035 |
| RFL 121 | Wheat-Rye-6R.300k_Assembly_Contig_95_1 | 482 | 2036 |
| RFL 122 | Primepii.300k_Assembly_Contig_90_1 | 483 | 2037 |
| RFL 122 | R197.300k_Assembly_Contig_68_1 | 484 | 2038 |
| RFL 122 | Anapurna.300k_Assembly_Contig_63_1 | 485 | 2039 |
| RFL 122 | R0932E.300k_Assembly_Contig_91_1 | 486 | 2040 |
| RFL 122 | R0934F.300k_Assembly_Contig_97_1 | 487 | 2041 |
| RFL 122 | Triticum-timopheevii.300k_Assembly_Contig_59_1 | 488 | 2042 |
| RFL 122 | Wheat-Rye-6R.300k_Assembly_Contig_85_1 | 489 | 2043 |
| RFL 123 | Triticum-timopheevii.300k_Assembly_Contig_65_1 | 490 | 2044 |
| RFL 124 | Primepii.300k_Assembly_Contig_96_1 | 491 | 2045 |
| RFL 124 | R197.300k_Assembly_Contig_116_1 | 492 | 2046 |
| RFL 124 | R0934F.300k_Assembly_Contig_110_1 | 493 | 2047 |
| RFL 124 | Wheat-Rye-6R.300k_Assembly_Contig_92_1 | 494 | 2048 |
| RFL 124 | Anapurna.300k_Assembly_Contig_84_1 | 495 | 2049 |
| RFL 124 | R0932E.300k_Assembly_Contig_107_1 | 496 | 2050 |
| RFL 125 | Triticum-timopheevii.300k_Assembly_Contig_40_1 | 497 | 2051 |
| RFL 125 | Triticum-timopheevii.300k_Assembly_Contig_41_3 | 498 | 2052 |
| RFL 125 | R197.300k_Assembly_Contig_3_1 | 499 | 2053 |
| RFL 126 | R0932E.300k_Assembly_Contig_35_1 | 500 | 2054 |
| RFL 126 | R197.300k_Assembly_Contig_9_3 | 501 | 2055 |
| RFL 126 | R0932E.300k_Assembly_Contig_35_2 | 502 | 2056 |
| RFL 126 | Anapurna.300k_Assembly_Contig_18_3 | 503 | 2057 |
| RFL 126 | Primepii.300k_Assembly_Contig_5_3 | 504 | 2058 |
| RFL 126 | Wheat-Rye-6R.300k_Assembly_Contig_29_1 | 505 | 2059 |
| RFL 126 | R0934F.300k_Assembly_Contig_19_3 | 506 | 2060 |
| RFL 126 | Wheat-Rye-6R.300k_Assembly_Contig_14_3 | 507 | 2061 |
| RFL 126 | Triticum-timopheevii.300k_Assembly_Contig_24_1 | 508 | 2062 |
| RFL 126 | Primepii.300k_Assembly_Contig_43_1 | 509 | 2063 |
| RFL 126 | R0934F.300k_Assembly_Contig_30_2 | 510 | 2064 |
| RFL 126 | R0934F.300k_Assembly_Contig_30_1 | 511 | 2065 |
| RFL 126 | R197.300k_Assembly_Contig_16_1 | 512 | 2066 |
| RFL 126 | R0932E.300k_Assembly_Contig_16_3 | 513 | 2067 |
| RFL 126 | Anapurna.300k_Assembly_Contig_11_1 | 514 | 2068 |
| RFL 127 | Anapurna.300k_Assembly_Contig_73_1 | 515 | 2069 |
| RFL 128 | R197.300k_Assembly_Contig_113_2 | 516 | 2070 |
| RFL 129 | R0932E.300k_Assembly_Contig_104_1 | 517 | 2071 |
| RFL 129 | R0934F.300k_Assembly_Contig_91_1 | 518 | 2072 |
| RFL 129 | R197.300k_Assembly_Contig_101_1 | 519 | 2073 |
| RFL 130 | Triticum-timopheevii.300k_Assembly_Contig_53_2 | 520 | 2074 |
| RFL 131 | R0934F.300k_Assembly_Contig_106_1 | 521 | 2075 |
| RFL 131 | Anapurna.300k_Assembly_Contig_94_1 | 522 | 2076 |
| RFL 131 | Primepii.300k_Assembly_Contig_112_1 | 523 | 2077 |
| RFL 132 | R197.300k_Assembly_Contig_82_1 | 524 | 2078 |
| RFL 132 | Wheat-Rye-6R.300k_Assembly_Contig_96_1 | 525 | 2079 |
| RFL 132 | Primepii.300k_Assembly_Contig_87_1 | 526 | 2080 |
| RFL 133 | R0932E.300k_Assembly_Contig_28_2 | 527 | 2081 |
| RFL 133 | Anapurna.300k_Assembly_Contig_7_2 | 528 | 2082 |
| RFL 133 | Primepii.300k_Assembly_Contig_26_2 | 529 | 2083 |
| RFL 134 | Wheat-Rye-6R.300k_Assembly_Contig_106_1 | 530 | 2084 |
| RFL 134 | R197.300k_Assembly_Contig_100_1 | 531 | 2085 |
| RFL 134 | Primepii.300k_Assembly_Contig_102_1 | 532 | 2086 |
| RFL 135 | Triticum-timopheevii.300k_Assembly_Contig_93_1 | 533 | 2087 |
| RFL 136 | Primepii.300k_Assembly_Contig_73_1 | 534 | 2088 |
| RFL 136 | R0934F.300k_Assembly_Contig_77_1 | 535 | 2089 |
| RFL 136 | R0932E.300k_Assembly_Contig_65_1 | 536 | 2090 |
| RFL 136 | Anapurna.300k_Assembly_Contig_52_1 | 537 | 2091 |
| RFL 136 | Wheat-Rye-6R.300k_Assembly_Contig_84_1 | 538 | 2092 |
| RFL 136 | R197.300k_Assembly_Contig_81_1 | 539 | 2093 |
| RFL 137 | R0934F.300k_Assembly_Contig_21_3 | 540 | 2094 |
| RFL 137 | R0932E.300k_Assembly_Contig_10_3 | 541 | 2095 |
| RFL 137 | Primepii.300k_Assembly_Contig_48_3 | 542 | 2096 |
| RFL 137 | Anapurna.300k_Assembly_Contig_9_3 | 543 | 2097 |
| RFL 137 | Wheat-Rye-6R.300k_Assembly_Contig_20_3 | 544 | 2098 |
| RFL 137 | R197.300k_Assembly_Contig_2_3 | 545 | 2099 |

TABLE 7-continued

| RFL-Name | Name | SEQID-PRT1 | SEQID-DNA |
|---|---|---|---|
| RFL 138 | R0934F.300k_Assembly_Contig_201_1 | 546 | 2100 |
| RFL 138 | Triticum-timopheevii.300k_Assembly_Contig_1_1 | 547 | 2101 |
| RFL 138 | R0934F.300k_Assembly_Contig_1_1 | 548 | 2102 |
| RFL 139 | R0934F.300k_Assembly_Contig_74_2 | 549 | 2103 |
| RFL 139 | Primepii.300k_Assembly_Contig_79_2 | 550 | 2104 |
| RFL 139 | Wheat-Rye-6R.300k_Assembly_Contig_70_2 | 551 | 2105 |
| RFL 139 | Anapurna.300k_Assembly_Contig_64_2 | 552 | 2106 |
| RFL 140 | Primepii.300k_Assembly_Contig_105_2 | 553 | 2107 |
| RFL 140 | R0934F.300k_Assembly_Contig_56_2 | 554 | 2108 |
| RFL 141 | R0932E.300k_Assembly_Contig_75_1 | 555 | 2109 |
| RFL 141 | R0934F.300k_Assembly_Contig_50_1 | 556 | 2110 |
| RFL 142 | R0934F.300k_Assembly_Contig_76_1 | 557 | 2111 |
| RFL 142 | Primepii.300k_Assembly_Contig_75_1 | 558 | 2112 |
| RFL 143 | Wheat-Rye-6R.300k_Assembly_Contig_3_1 | 559 | 2113 |
| RFL 143 | R0934F.300k_Assembly_Contig_9_1 | 560 | 2114 |
| RFL 143 | Primepii.300k_Assembly_Contig_3_1 | 561 | 2115 |
| RFL 143 | R197.300k_Assembly_Contig_8_1 | 562 | 2116 |
| RFL 143 | R0932E.300k_Assembly_Contig_3_1 | 563 | 2117 |
| RFL 143 | Anapurna.300k_Assembly_Contig_3_1 | 564 | 2118 |
| RFL 144 | Anapurna.300k_Assembly_Contig_49_1 | 565 | 2119 |
| RFL 144 | Wheat-Rye-6R.300k_Assembly_Contig_58_1 | 566 | 2120 |
| RFL 144 | R197.300k_Assembly_Contig_56_1 | 567 | 2121 |
| RFL 144 | R0934F.300k_Assembly_Contig_40_1 | 568 | 2122 |
| RFL 144 | Primepii.300k_Assembly_Contig_58_1 | 569 | 2123 |
| RFL 144 | R0932E.300k_Assembly_Contig_50_1 | 570 | 2124 |
| RFL 145 | R0932E.300k_Assembly_Contig_62_1 | 571 | 2125 |
| RFL 145 | R0934F.300k_Assembly_Contig_52_1 | 572 | 2126 |
| RFL 145 | Anapurna.300k_Assembly_Contig_53_1 | 573 | 2127 |
| RFL 145 | Primepii.300k_Assembly_Contig_34_2 | 574 | 2128 |
| RFL 145 | R197.300k_Assembly_Contig_44_2 | 575 | 2129 |
| RFL 145 | Wheat-Rye-6R.300k_Assembly_Contig_36_2 | 576 | 2130 |
| RFL 146 | Anapurna.300k_Assembly_Contig_46_3 | 577 | 2131 |
| RFL 146 | R197.300k_Assembly_Contig_147_3 | 578 | 2132 |
| RFL 146 | Wheat-Rye-6R.300k_Assembly_Contig_18_3 | 579 | 2133 |
| RFL 146 | R0932E.300k_Assembly_Contig_42_3 | 580 | 2134 |
| RFL 147 | Anapurna.300k_Assembly_Contig_36_4 | 581 | 2135 |
| RFL 147 | R0934F.300k_Assembly_Contig_35_3 | 582 | 2136 |
| RFL 147 | Anapurna.300k_Assembly_Contig_36_3 | 583 | 2137 |
| RFL 147 | Wheat-Rye-6R.300k_Assembly_Contig_43_3 | 584 | 2138 |
| RFL 147 | R0932E.300k_Assembly_Contig_49_3 | 585 | 2139 |
| RFL 147 | R197.300k_Assembly_Contig_2_6 | 586 | 2140 |
| RFL 147 | Primepii.300k_Assembly_Contig_32_3 | 587 | 2141 |
| RFL 148 | R197.300k_Assembly_Contig_28_2 | 588 | 2142 |
| RFL 148 | R0934F.300k_Assembly_Contig_13_2 | 589 | 2143 |
| RFL 148 | Primepii.300k_Assembly_Contig_4_2 | 590 | 2144 |
| RFL 148 | R0932E.300k_Assembly_Contig_218_1 | 591 | 2145 |
| RFL 149 | Triticum-timopheevii.300k_Assembly_Contig_18_2 | 592 | 2146 |
| RFL 150 | Triticum-timopheevii.300k_Assembly_Contig_66_3 | 593 | 2147 |
| RFL 151 | R0934F.300k_Assembly_Contig_215_1 | 594 | 2148 |
| RFL 151 | Primepii.300k_Assembly_Contig_119_1 | 595 | 2149 |
| RFL 151 | R197.300k_Assembly_Contig_114_1 | 596 | 2150 |
| RFL 152 | Triticum-timopheevii.300k_Assembly_Contig_114_1 | 597 | 2151 |
| RFL 152 | R0934F.300k_Assembly_Contig_177_1 | 598 | 2152 |
| RFL 153 | R0932E.300k_Assembly_Contig_121_1 | 599 | 2153 |
| RFL 153 | Anapurna.300k_Assembly_Contig_124_1 | 600 | 2154 |
| RFL 153 | Primepii.300k_Assembly_Contig_126_1 | 601 | 2155 |
| RFL 153 | R0934F.300k_Assembly_Contig_206_1 | 602 | 2156 |
| RFL 153 | R0934F.300k_Assembly_Contig_147_1 | 603 | 2157 |
| RFL 154 | R0934F.300k_Assembly_Contig_174_1 | 604 | 2158 |
| RFL 154 | Primepii.300k_Assembly_Contig_143_1 | 605 | 2159 |
| RFL 154 | Primepii.300k_Assembly_Contig_120_1 | 606 | 2160 |
| RFL 154 | R0934F.300k_Assembly_Contig_134_1 | 607 | 2161 |
| RFL 154 | Primepii.300k_Assembly_Contig_125_1 | 608 | 2162 |
| RFL 154 | Wheat-Rye-6R.300k_Assembly_Contig_42_1 | 609 | 2163 |
| RFL 154 | R0934F.300k_Assembly_Contig_139_1 | 610 | 2164 |
| RFL 154 | R197.300k_Assembly_Contig_123_1 | 611 | 2165 |
| RFL 154 | R0932E.300k_Assembly_Contig_168_1 | 612 | 2166 |
| RFL 154 | R0932E.300k_Assembly_Contig_37_1 | 613 | 2167 |
| RFL 154 | Anapurna.300k_Assembly_Contig_135_1 | 614 | 2168 |
| RFL 154 | R197.300k_Assembly_Contig_140_1 | 615 | 2169 |
| RFL 154 | R197.300k_Assembly_Contig_161_1 | 616 | 2170 |
| RFL 154 | Anapurna.300k_Assembly_Contig_112_1 | 617 | 2171 |
| RFL 154 | Wheat-Rye-6R.300k_Assembly_Contig_160_1 | 618 | 2172 |
| RFL 154 | R0934F.300k_Assembly_Contig_182_1 | 619 | 2173 |

TABLE 7-continued

| RFL-Name | Name | SEQID-PRT1 | SEQID-DNA |
|---|---|---|---|
| RFL 154 | R0934F.300k_Assembly_Contig_200_1 | 620 | 2174 |
| RFL 154 | Wheat-Rye-6R.300k_Assembly_Contig_105_1 | 621 | 2175 |
| RFL 154 | Primepii.300k_Assembly_Contig_176_1 | 622 | 2176 |
| RFL 154 | R0934F.300k_Assembly_Contig_165_1 | 623 | 2177 |
| RFL 154 | Wheat-Rye-6R.300k_Assembly_Contig_200_1 | 624 | 2178 |
| RFL 154 | R197.300k_Assembly_Contig_13_1 | 625 | 2179 |
| RFL 154 | R197.300k_Assembly_Contig_158_1 | 626 | 2180 |
| RFL 154 | Primepii.300k_Assembly_Contig_160_1 | 627 | 2181 |
| RFL 154 | R0932E.300k_Assembly_Contig_156_1 | 628 | 2182 |
| RFL 154 | R0932E.300k_Assembly_Contig_179_1 | 629 | 2183 |
| RFL 154 | Anapurna.300k_Assembly_Contig_128_1 | 630 | 2184 |
| RFL 154 | Anapurna.300k_Assembly_Contig_104_1 | 631 | 2185 |
| RFL 154 | R0932E.300k_Assembly_Contig_177_1 | 632 | 2186 |
| RFL 155 | R197.300k_Assembly_Contig_127_1 | 633 | 2187 |
| RFL 155 | R0934F.300k_Assembly_Contig_109_1 | 634 | 2188 |
| RFL 155 | Wheat-Rye-6R.300k_Assembly_Contig_121_1 | 635 | 2189 |
| RFL 155 | Anapurna.300k_Assembly_Contig_108_1 | 636 | 2190 |
| RFL 155 | R0932E.300k_Assembly_Contig_122_1 | 637 | 2191 |
| RFL 155 | Primepii.300k_Assembly_Contig_110_1 | 638 | 2192 |
| RFL 156 | Wheat-Rye-6R.300k_Assembly_Contig_130_1 | 639 | 2193 |
| RFL 156 | Anapurna.300k_Assembly_Contig_117_2 | 640 | 2194 |
| RFL 156 | R0934F.300k_Assembly_Contig_176_1 | 641 | 2195 |
| RFL 156 | Anapurna.300k_Assembly_Contig_171_1 | 642 | 2196 |
| RFL 156 | R0932E.300k_Assembly_Contig_154_2 | 643 | 2197 |
| RFL 156 | Primepii.300k_Assembly_Contig_134_2 | 644 | 2198 |
| RFL 157 | Primepii.300k_Assembly_Contig_108_1 | 645 | 2199 |
| RFL 157 | R197.300k_Assembly_Contig_97_1 | 646 | 2200 |
| RFL 157 | Wheat-Rye-6R.300k_Assembly_Contig_117_1 | 647 | 2201 |
| RFL 157 | Anapurna.300k_Assembly_Contig_105_1 | 648 | 2202 |
| RFL 157 | R0932E.300k_Assembly_Contig_126_1 | 649 | 2203 |
| RFL 157 | R0934F.300k_Assembly_Contig_116_1 | 650 | 2204 |
| RFL 158 | R197.300k_Assembly_Contig_105_3 | 651 | 2205 |
| RFL 158 | Anapurna.300k_Assembly_Contig_89_3 | 652 | 2206 |
| RFL 158 | Wheat-Rye-6R.300k_Assembly_Contig_88_3 | 653 | 2207 |
| RFL 158 | R0934F.300k_Assembly_Contig_83_3 | 654 | 2208 |
| RFL 158 | Primepii.300k_Assembly_Contig_77_3 | 655 | 2209 |
| RFL 158 | R0932E.300k_Assembly_Contig_80_3 | 656 | 2210 |
| RFL 159 | Wheat-Rye-6R.300k_Assembly_Contig_177_1 | 657 | 2211 |
| RFL 159 | Wheat-Rye-6R.300k_Assembly_Contig_185_1 | 658 | 2212 |
| RFL 159 | Anapurna.300k_Assembly_Contig_176_1 | 659 | 2213 |
| RFL 159 | R197.300k_Assembly_Contig_191_1 | 660 | 2214 |
| RFL 160 | Triticum-timopheevii.300k_Assembly_Contig_111_1 | 661 | 2215 |
| RFL 161 | R197.300k_Assembly_Contig_28_3 | 662 | 2216 |
| RFL 161 | R0934F.300k_Assembly_Contig_13_3 | 663 | 2217 |
| RFL 161 | Anapurna.300k_Assembly_Contig_27_3 | 664 | 2218 |
| RFL 161 | R0932E.300k_Assembly_Contig_9_3 | 665 | 2219 |
| RFL 161 | Primepii.300k_Assembly_Contig_4_3 | 666 | 2220 |
| RFL 161 | R0932E.300k_Assembly_Contig_218_2 | 667 | 2221 |
| RFL 161 | Wheat-Rye-6R.300k_Assembly_Contig_4_4 | 668 | 2222 |
| RFL 162 | Triticum-timopheevii.300k_Assembly_Contig_94_1 | 669 | 2223 |
| RFL 163 | Primepii.300k_Assembly_Contig_128_1 | 670 | 2224 |
| RFL 163 | Wheat-Rye-6R.300k_Assembly_Contig_133_1 | 671 | 2225 |
| RFL 163 | R197.300k_Assembly_Contig_133_2 | 672 | 2226 |
| RFL 163 | R0932E.300k_Assembly_Contig_133_2 | 673 | 2227 |
| RFL 163 | R0934F.300k_Assembly_Contig_125_1 | 674 | 2228 |
| RFL 163 | Anapurna.300k_Assembly_Contig_122_2 | 675 | 2229 |
| RFL 164 | Primepii.300k_Assembly_Contig_127_1 | 676 | 2230 |
| RFL 164 | R0934F.300k_Assembly_Contig_124_1 | 677 | 2231 |
| RFL 165 | Anapurna.300k_Assembly_Contig_145_1 | 678 | 2232 |
| RFL 165 | R197.300k_Assembly_Contig_149_1 | 679 | 2233 |
| RFL 165 | Primepii.300k_Assembly_Contig_139_1 | 680 | 2234 |
| RFL 165 | R0932E.300k_Assembly_Contig_140_1 | 681 | 2235 |
| RFL 165 | Wheat-Rye-6R.300k_Assembly_Contig_139_1 | 682 | 2236 |
| RFL 165 | R0934F.300k_Assembly_Contig_132_1 | 683 | 2237 |
| RFL 166 | Primepii.300k_Assembly_Contig_130_1 | 684 | 2238 |
| RFL 166 | R0934F.300k_Assembly_Contig_122_2 | 685 | 2239 |
| RFL 167 | R197.300k_Assembly_Contig_118_1 | 686 | 2240 |
| RFL 167 | Anapurna.300k_Assembly_Contig_93_1 | 687 | 2241 |
| RFL 167 | R0932E.300k_Assembly_Contig_96_1 | 688 | 2242 |
| RFL 167 | R0934F.300k_Assembly_Contig_100_1 | 689 | 2243 |
| RFL 167 | Wheat-Rye-6R.300k_Assembly_Contig_107_1 | 690 | 2244 |
| RFL 167 | Primepii.300k_Assembly_Contig_100_1 | 691 | 2245 |
| RFL 168 | Triticum-timopheevii.300k_Assembly_Contig_88_1 | 692 | 2246 |
| RFL 168 | Triticum-timopheevii.300k_Assembly_Contig_28_1 | 693 | 2247 |

TABLE 7-continued

| RFL-Name | Name | SEQID-PRT1 | SEQID-DNA |
|---|---|---|---|
| RFL 169 | Triticum-timopheevii.300k_Assembly_Contig_86_2 | 694 | 2248 |
| RFL 170 | R197.300k_Assembly_Contig_94_2 | 695 | 2249 |
| RFL 170 | R0934F.300k_Assembly_Contig_67_2 | 696 | 2250 |
| RFL 170 | Primepii.300k_Assembly_Contig_60_2 | 697 | 2251 |
| RFL 170 | Wheat-Rye-6R.300k_Assembly_Contig_113_2 | 698 | 2252 |
| RFL 170 | Anapurna.300k_Assembly_Contig_174_3 | 699 | 2253 |
| RFL 171 | Triticum-timopheevii.300k_Assembly_Contig_84_1 | 700 | 2254 |
| RFL 171 | Triticum-timopheevii.300k_Assembly_Contig_46_1 | 701 | 2255 |
| RFL 172 | R0932E.300k_Assembly_Contig_67_1 | 702 | 2256 |
| RFL 172 | Wheat-Rye-6R.300k_Assembly_Contig_57_1 | 703 | 2257 |
| RFL 172 | R0934F.300k_Assembly_Contig_82_1 | 704 | 2258 |
| RFL 172 | Primepii.300k_Assembly_Contig_68_1 | 705 | 2259 |
| RFL 172 | Anapurna.300k_Assembly_Contig_32_1 | 706 | 2260 |
| RFL 172 | R197.300k_Assembly_Contig_61_1 | 707 | 2261 |
| RFL 173 | Triticum-timopheevii.300k_Assembly_Contig_83_1 | 708 | 2262 |
| RFL 174 | Triticum-timopheevii.300k_Assembly_Contig_41_1 | 709 | 2263 |
| RFL 174 | R197.300k_Assembly_Contig_102_1 | 710 | 2264 |
| RFL 174 | Triticum-timopheevii.300k_Assembly_Contig_41_2 | 711 | 2265 |
| RFL 175 | Primepii.300k_Assembly_Contig_200_1 | 712 | 2266 |
| RFL 175 | Primepii.300k_Assembly_Contig_162_1 | 713 | 2267 |
| RFL 175 | R0932E.300k_Assembly_Contig_144_1 | 714 | 2268 |
| RFL 175 | R0934F.300k_Assembly_Contig_156_1 | 715 | 2269 |
| RFL 175 | Anapurna.300k_Assembly_Contig_123_1 | 716 | 2270 |
| RFL 176 | R197.300k_Assembly_Contig_93_1 | 717 | 2271 |
| RFL 176 | R0934F.300k_Assembly_Contig_90_1 | 718 | 2272 |
| RFL 176 | Wheat-Rye-6R.300k_Assembly_Contig_100_1 | 719 | 2273 |
| RFL 176 | Anapurna.300k_Assembly_Contig_86_1 | 720 | 2274 |
| RFL 176 | R0932E.300k_Assembly_Contig_108_1 | 721 | 2275 |
| RFL 177 | R197.300k_Assembly_Contig_128_1 | 722 | 2276 |
| RFL 177 | Wheat-Rye-6R.300k_Assembly_Contig_126_1 | 723 | 2277 |
| RFL 177 | Anapurna.300k_Assembly_Contig_127_1 | 724 | 2278 |
| RFL 177 | R0932E.300k_Assembly_Contig_135_1 | 725 | 2279 |
| RFL 178 | Primepii.300k_Assembly_Contig_97_1 | 726 | 2280 |
| RFL 179 | Triticum-timopheevii.300k_Assembly_Contig_89_1 | 727 | 2281 |
| RFL 180 | R0932E.300k_Assembly_Contig_160_1 | 728 | 2282 |
| RFL 180 | Triticum-timopheevii.300k_Assembly_Contig_97_1 | 729 | 2283 |
| RFL 180 | Primepii.300k_Assembly_Contig_141_1 | 730 | 2284 |
| RFL 180 | R197.300k_Assembly_Contig_141_1 | 731 | 2285 |
| RFL 180 | Wheat-Rye-6R.300k_Assembly_Contig_149_1 | 732 | 2286 |
| RFL 180 | Anapurna.300k_Assembly_Contig_142_1 | 733 | 2287 |
| RFL 180 | R0934F.300k_Assembly_Contig_146_1 | 734 | 2288 |
| RFL 181 | Wheat-Rye-6R.300k_Assembly_Contig_104_1 | 735 | 2289 |
| RFL 181 | Primepii.300k_Assembly_Contig_104_1 | 736 | 2290 |
| RFL 182 | Wheat-Rye-6R.300k_Assembly_Contig_53_2 | 737 | 2291 |
| RFL 182 | R197.300k_Assembly_Contig_19_2 | 738 | 2292 |
| RFL 182 | R0932E.300k_Assembly_Contig_68_2 | 739 | 2293 |
| RFL 183 | R0932E.300k_Assembly_Contig_31_2 | 740 | 2294 |
| RFL 183 | R197.300k_Assembly_Contig_49_2 | 741 | 2295 |
| RFL 183 | R0934F.300k_Assembly_Contig_41_2 | 742 | 2296 |
| RFL 183 | Wheat-Rye-6R.300k_Assembly_Contig_27_2 | 743 | 2297 |
| RFL 183 | Triticum-timopheevii.300k_Assembly_Contig_26_1 | 744 | 2298 |
| RFL 183 | Anapurna.300k_Assembly_Contig_40_2 | 745 | 2299 |
| RFL 183 | Primepii.300k_Assembly_Contig_65_2 | 746 | 2300 |
| RFL 184 | R0932E.300k_Assembly_Contig_63_1 | 747 | 2301 |
| RFL 184 | R197.300k_Assembly_Contig_35_1 | 748 | 2302 |
| RFL 184 | Anapurna.300k_Assembly_Contig_170_1 | 749 | 2303 |
| RFL 184 | Wheat-Rye-6R.300k_Assembly_Contig_61_1 | 750 | 2304 |
| RFL 185 | R0934F.300k_Assembly_Contig_92_3 | 751 | 2305 |
| RFL 185 | Triticum-timopheevii.300k_Assembly_Contig_52_3 | 752 | 2306 |
| RFL 185 | R0932E.300k_Assembly_Contig_109_3 | 753 | 2307 |
| RFL 185 | R197.300k_Assembly_Contig_90_3 | 754 | 2308 |
| RFL 186 | Wheat-Rye-6R.300k_Assembly_Contig_131_1 | 755 | 2309 |
| RFL 186 | R0932E.300k_Assembly_Contig_141_1 | 756 | 2310 |
| RFL 186 | R197.300k_Assembly_Contig_143_1 | 757 | 2311 |
| RFL 186 | R0934F.300k_Assembly_Contig_133_1 | 758 | 2312 |
| RFL 186 | Anapurna.300k_Assembly_Contig_139_1 | 759 | 2313 |
| RFL 186 | Primepii.300k_Assembly_Contig_144_1 | 760 | 2314 |
| RFL 187 | R0934F.300k_Assembly_Contig_53_3 | 761 | 2315 |

TABLE 7-continued

| RFL-Name | Name | SEQID-PRT1 | SEQID-DNA |
|---|---|---|---|
| RFL 187 | Primepii.300k_Assembly_Contig_28_3 | 762 | 2316 |
| RFL 187 | R197.300k_Assembly_Contig_53_3 | 763 | 2317 |
| RFL 187 | R0932E.300k_Assembly_Contig_14_3 | 764 | 2318 |
| RFL 187 | Wheat-Rye-6R.300k_Assembly_Contig_49_3 | 765 | 2319 |
| RFL 187 | Anapurna.300k_Assembly_Contig_55_3 | 766 | 2320 |
| RFL 189 | Triticum-timopheevii.300k_Assembly_Contig_23_1 | 767 | 2321 |
| RFL 191 | R197.300k_Assembly_Contig_136_1 | 768 | 2322 |
| RFL 192 | R0934F.300k_Assembly_Contig_119_1 | 769 | 2323 |
| RFL 192 | R197.300k_Assembly_Contig_134_1 | 770 | 2324 |
| RFL 192 | Wheat-Rye-6R.300k_Assembly_Contig_125_1 | 771 | 2325 |
| RFL 192 | Primepii.300k_Assembly_Contig_133_1 | 772 | 2326 |
| RFL 192 | Anapurna.300k_Assembly_Contig_125_1 | 773 | 2327 |
| RFL 192 | R0932E.300k_Assembly_Contig_136_1 | 774 | 2328 |
| RFL 193 | R0932E.300k_Assembly_Contig_130_1 | 775 | 2329 |
| RFL 193 | R0934F.300k_Assembly_Contig_95_1 | 776 | 2330 |
| RFL 193 | Anapurna.300k_Assembly_Contig_107_1 | 777 | 2331 |
| RFL 193 | R197.300k_Assembly_Contig_110_1 | 778 | 2332 |
| RFL 194 | Primepii.300k_Assembly_Contig_107_1 | 779 | 2333 |
| RFL 194 | R197.300k_Assembly_Contig_99_1 | 780 | 2334 |
| RFL 194 | Wheat-Rye-6R.300k_Assembly_Contig_156_1 | 781 | 2335 |
| RFL 194 | R197.300k_Assembly_Contig_132_1 | 782 | 2336 |
| RFL 194 | Primepii.300k_Assembly_Contig_121_1 | 783 | 2337 |
| RFL 194 | Wheat-Rye-6R.300k_Assembly_Contig_51_1 | 784 | 2338 |
| RFL 195 | Wheat-Rye-6R.300k_Assembly_Contig_165_1 | 785 | 2339 |
| RFL 195 | R0934F.300k_Assembly_Contig_163_1 | 786 | 2340 |
| RFL 195 | R0932E.300k_Assembly_Contig_95_1 | 787 | 2341 |
| RFL 195 | Primepii.300k_Assembly_Contig_171_1 | 788 | 2342 |
| RFL 195 | Anapurna.300k_Assembly_Contig_2_4 | 789 | 2343 |
| RFL 195 | R197.300k_Assembly_Contig_176_1 | 790 | 2344 |
| RFL 196 | Anapurna.300k_Assembly_Contig_81_2 | 791 | 2345 |
| RFL 196 | R197.300k_Assembly_Contig_88_2 | 792 | 2346 |
| RFL 196 | Wheat-Rye-6R.300k_Assembly_Contig_114_2 | 793 | 2347 |
| RFL 196 | R0934F.300k_Assembly_Contig_112_2 | 794 | 2348 |
| RFL 196 | Primepii.300k_Assembly_Contig_103_2 | 795 | 2349 |
| RFL 196 | R0932E.300k_Assembly_Contig_106_2 | 796 | 2350 |
| RFL 197 | Wheat-Rye-6R.300k_Assembly_Contig_89_1 | 797 | 2351 |
| RFL 197 | R0932E.300k_Assembly_Contig_84_1 | 798 | 2352 |
| RFL 197 | R197.300k_Assembly_Contig_89_1 | 799 | 2353 |
| RFL 197 | Primepii.300k_Assembly_Contig_78_1 | 800 | 2354 |
| RFL 197 | Anapurna.300k_Assembly_Contig_65_1 | 801 | 2355 |
| RFL 197 | R0934F.300k_Assembly_Contig_105_1 | 802 | 2356 |
| RFL 198 | Wheat-Rye-6R.300k_Assembly_Contig_155_1 | 803 | 2357 |
| RFL 198 | R0934F.300k_Assembly_Contig_151_1 | 804 | 2358 |
| RFL 198 | R197.300k_Assembly_Contig_157_1 | 805 | 2359 |
| RFL 198 | Anapurna.300k_Assembly_Contig_150_1 | 806 | 2360 |
| RFL 198 | Primepii.300k_Assembly_Contig_157_1 | 807 | 2361 |
| RFL 198 | R0932E.300k_Assembly_Contig_169_1 | 808 | 2362 |
| RFL 199 | R0934F.300k_Assembly_Contig_170_1 | 809 | 2363 |
| RFL 199 | Anapurna.300k_Assembly_Contig_166_1 | 810 | 2364 |
| RFL 199 | R0932E.300k_Assembly_Contig_181_1 | 811 | 2365 |
| RFL 199 | R197.300k_Assembly_Contig_178_1 | 812 | 2366 |
| RFL 199 | Primepii.300k_Assembly_Contig_175_2 | 813 | 2367 |
| RFL 199 | Primepii.300k_Assembly_Contig_175_1 | 814 | 2368 |
| RFL 199 | Triticum-timopheevii.300k_Assembly_Contig_110_1 | 815 | 2369 |
| RFL 199 | Wheat-Rye-6R.300k_Assembly_Contig_171_1 | 816 | 2370 |
| RFL 200 | Wheat-Rye-6R.300k_Assembly_Contig_154_1 | 817 | 2371 |
| RFL 200 | Primepii.300k_Assembly_Contig_149_1 | 818 | 2372 |
| RFL 200 | R197.300k_Assembly_Contig_148_1 | 819 | 2373 |
| RFL 200 | Anapurna.300k_Assembly_Contig_151_1 | 820 | 2374 |
| RFL 200 | R0932E.300k_Assembly_Contig_158_1 | 821 | 2375 |
| RFL 200 | R0934F.300k_Assembly_Contig_135_1 | 822 | 2376 |
| RFL 201 | Anapurna.300k_Assembly_Contig_156_1 | 823 | 2377 |
| RFL 201 | Wheat-Rye-6R.300k_Assembly_Contig_152_1 | 824 | 2378 |
| RFL 201 | R0934F.300k_Assembly_Contig_162_1 | 825 | 2379 |
| RFL 201 | Triticum-timopheevii.300k_Assembly_Contig_95_1 | 826 | 2380 |
| RFL 201 | Primepii.300k_Assembly_Contig_153_1 | 827 | 2381 |
| RFL 201 | R197.300k_Assembly_Contig_162_1 | 828 | 2382 |
| RFL 201 | R0932E.300k_Assembly_Contig_159_1 | 829 | 2383 |
| RFL 202 | Anapurna.300k_Assembly_Contig_157_1 | 830 | 2384 |
| RFL 202 | Wheat-Rye-6R.300k_Assembly_Contig_164_1 | 831 | 2385 |
| RFL 202 | R197.300k_Assembly_Contig_166_1 | 832 | 2386 |
| RFL 202 | R0932E.300k_Assembly_Contig_165_1 | 833 | 2387 |
| RFL 202 | R0934F.300k_Assembly_Contig_154_1 | 834 | 2388 |

TABLE 7-continued

| RFL-Name | Name | SEQID-PRT1 | SEQID-DNA |
|---|---|---|---|
| RFL 202 | Primepii.300k_Assembly_Contig_167_1 | 835 | 2389 |
| RFL 203 | Triticum-timopheevii.300k_Assembly_Contig_105_1 | 836 | 2390 |
| RFL 203 | Triticum-timopheevii.300k_Assembly_Contig_119_1 | 837 | 2391 |
| RFL 203 | Wheat-Rye-6R.300k_Assembly_Contig_147_1 | 838 | 2392 |
| RFL 203 | R0932E.300k_Assembly_Contig_173_2 | 839 | 2393 |
| RFL 203 | R0932E.300k_Assembly_Contig_173_1 | 840 | 2394 |
| RFL 203 | Triticum-timopheevii.300k_Assembly_Contig_3_1 | 841 | 2395 |
| RFL 203 | Triticum-timopheevii.300k_Assembly_Contig_120_1 | 842 | 2396 |
| RFL 203 | R197.300k_Assembly_Contig_150_1 | 843 | 2397 |
| RFL 203 | Anapurna.300k_Assembly_Contig_153_1 | 844 | 2398 |
| RFL 203 | R0934F.300k_Assembly_Contig_157_2 | 845 | 2399 |
| RFL 203 | Primepii.300k_Assembly_Contig_156_1 | 846 | 2400 |
| RFL 203 | R0934F.300k_Assembly_Contig_157_1 | 847 | 2401 |
| RFL 204 | Triticum-timopheevii.300k_Assembly_Contig_103_1 | 848 | 2402 |
| RFL 204 | Triticum-timopheevii.300k_Assembly_Contig_100_1 | 849 | 2403 |
| RFL 205 | Triticum-timopheevii.300k_Assembly_Contig_96_1 | 850 | 2404 |
| RFL 205 | R0932E.300k_Assembly_Contig_155_1 | 851 | 2405 |
| RFL 205 | Anapurna.300k_Assembly_Contig_140_1 | 852 | 2406 |
| RFL 205 | Primepii.300k_Assembly_Contig_148_1 | 853 | 2407 |
| RFL 205 | R197.300k_Assembly_Contig_151_1 | 854 | 2408 |
| RFL 205 | R0934F.300k_Assembly_Contig_159_1 | 855 | 2409 |
| RFL 205 | Wheat-Rye-6R.300k_Assembly_Contig_151_1 | 856 | 2410 |
| RFL 206 | R0932E.300k_Assembly_Contig_117_1 | 857 | 2411 |
| RFL 207 | Triticum-timopheevii.300k_Assembly_Contig_62_1 | 858 | 2412 |
| RFL 208 | Wheat-Rye-6R.300k_Assembly_Contig_136_1 | 859 | 2413 |
| RFL 209 | Wheat-Rye-6R.300k_Assembly_Contig_143_1 | 860 | 2414 |
| RFL 209 | R0934F.300k_Assembly_Contig_140_1 | 861 | 2415 |
| RFL 209 | R0932E.300k_Assembly_Contig_174_1 | 862 | 2416 |
| RFL 209 | R197.300k_Assembly_Contig_154_1 | 863 | 2417 |
| RFL 209 | Primepii.300k_Assembly_Contig_152_1 | 864 | 2418 |
| RFL 209 | Anapurna.300k_Assembly_Contig_141_1 | 865 | 2419 |
| RFL 210 | Wheat-Rye-6R.300k_Assembly_Contig_163_1 | 866 | 2420 |
| RFL 210 | Anapurna.300k_Assembly_Contig_149_1 | 867 | 2421 |
| RFL 210 | R0934F.300k_Assembly_Contig_152_1 | 868 | 2422 |
| RFL 210 | R197.300k_Assembly_Contig_168_1 | 869 | 2423 |
| RFL 210 | R0932E.300k_Assembly_Contig_172_1 | 870 | 2424 |
| RFL 210 | Primepii.300k_Assembly_Contig_166_1 | 871 | 2425 |
| RFL 211 | Triticum-timopheevii.300k_Assembly_Contig_99_1 | 872 | 2426 |
| RFL 212 | R0932E.300k_Assembly_Contig_99_1 | 873 | 2427 |
| RFL 212 | R197.300k_Assembly_Contig_85_2 | 874 | 2428 |
| RFL 212 | R0932E.300k_Assembly_Contig_97_2 | 875 | 2429 |
| RFL 212 | Triticum-timopheevii.300k_Assembly_Contig_73_1 | 876 | 2430 |
| RFL 212 | R0934F.300k_Assembly_Contig_94_2 | 877 | 2431 |
| RFL 212 | Wheat-Rye-6R.300k_Assembly_Contig_91_1 | 878 | 2432 |
| RFL 212 | Primepii.300k_Assembly_Contig_76_2 | 879 | 2433 |
| RFL 212 | R197.300k_Assembly_Contig_109_1 | 880 | 2434 |
| RFL 212 | Primepii.300k_Assembly_Contig_99_1 | 881 | 2435 |
| RFL 212 | R0934F.300k_Assembly_Contig_107_1 | 882 | 2436 |
| RFL 212 | Wheat-Rye-6R.300k_Assembly_Contig_68_2 | 883 | 2437 |
| RFL 212 | Anapurna.300k_Assembly_Contig_96_1 | 884 | 2438 |
| RFL 212 | Triticum-timopheevii.300k_Assembly_Contig_132_1 | 885 | 2439 |
| RFL 212 | Anapurna.300k_Assembly_Contig_75_2 | 886 | 2440 |
| RFL 213 | Primepii.300k_Assembly_Contig_61_2 | 887 | 2441 |
| RFL 213 | Wheat-Rye-6R.300k_Assembly_Contig_64_2 | 888 | 2442 |
| RFL 213 | Anapurna.300k_Assembly_Contig_69_2 | 889 | 2443 |
| RFL 213 | R0934F.300k_Assembly_Contig_65_2 | 890 | 2444 |
| RFL 213 | R197.300k_Assembly_Contig_48_2 | 891 | 2445 |
| RFL 213 | R0932E.300k_Assembly_Contig_70_2 | 892 | 2446 |
| RFL 215 | Triticum-timopheevii.300k_Assembly_Contig_98_1 | 893 | 2447 |
| RFL 216 | R197.300k_Assembly_Contig_96_2 | 894 | 2448 |
| RFL 216 | R0932E.300k_Assembly_Contig_93_2 | 895 | 2449 |
| RFL 216 | Anapurna.300k_Assembly_Contig_126_1 | 896 | 2450 |
| RFL 216 | R0934F.300k_Assembly_Contig_102_2 | 897 | 2451 |
| RFL 217 | Triticum-timopheevii.300k_Assembly_Contig_16_2 | 898 | 2452 |
| RFL 218 | Primepii.300k_Assembly_Contig_95_2 | 899 | 2453 |

TABLE 7-continued

| RFL-Name | Name | SEQID-PRT1 | SEQID-DNA |
|---|---|---|---|
| RFL 218 | Wheat-Rye-6R.300k_Assembly_Contig_166_1 | 900 | 2454 |
| RFL 218 | R197.300k_Assembly_Contig_112_2 | 901 | 2455 |
| RFL 219 | R0932E.300k_Assembly_Contig_105_1 | 902 | 2456 |
| RFL 219 | Wheat-Rye-6R.300k_Assembly_Contig_110_1 | 903 | 2457 |
| RFL 219 | R197.300k_Assembly_Contig_87_1 | 904 | 2458 |
| RFL 219 | Anapurna.300k_Assembly_Contig_91_1 | 905 | 2459 |
| RFL 219 | R0934F.300k_Assembly_Contig_101_1 | 906 | 2460 |
| RFL 219 | Primepii.300k_Assembly_Contig_98_1 | 907 | 2461 |
| RFL 220 | Primepii.300k_Assembly_Contig_115_2 | 908 | 2462 |
| RFL 220 | Wheat-Rye-6R.300k_Assembly_Contig_108_2 | 909 | 2463 |
| RFL 221 | R0934F.300k_Assembly_Contig_47_2 | 910 | 2464 |
| RFL 221 | R0932E.300k_Assembly_Contig_33_2 | 911 | 2465 |
| RFL 221 | Wheat-Rye-6R.300k_Assembly_Contig_16_2 | 912 | 2466 |
| RFL 221 | Anapurna.300k_Assembly_Contig_30_2 | 913 | 2467 |
| RFL 221 | R197.300k_Assembly_Contig_52_2 | 914 | 2468 |
| RFL 221 | Primepii.300k_Assembly_Contig_15_2 | 915 | 2469 |
| RFL 222 | Wheat-Rye-6R.300k_Assembly_Contig_97_1 | 916 | 2470 |
| RFL 222 | R197.300k_Assembly_Contig_108_1 | 917 | 2471 |
| RFL 222 | Anapurna.300k_Assembly_Contig_101_1 | 918 | 2472 |
| RFL 223 | R0934F.300k_Assembly_Contig_58_2 | 919 | 2473 |
| RFL 223 | Anapurna.300k_Assembly_Contig_25_3 | 920 | 2474 |
| RFL 223 | Wheat-Rye-6R.300k_Assembly_Contig_46_3 | 921 | 2475 |
| RFL 223 | R197.300k_Assembly_Contig_45_3 | 922 | 2476 |
| RFL 223 | R0932E.300k_Assembly_Contig_219_3 | 923 | 2477 |
| RFL 223 | Primepii.300k_Assembly_Contig_36_2 | 924 | 2478 |
| RFL 223 | R0932E.300k_Assembly_Contig_57_3 | 925 | 2479 |
| RFL 224 | R0932E.300k_Assembly_Contig_212_1 | 926 | 2480 |
| RFL 225 | R0932E.300k_Assembly_Contig_117_2 | 927 | 2481 |
| RFL 226 | R0932E.300k_Assembly_Contig_67_2 | 928 | 2482 |
| RFL 226 | Primepii.300k_Assembly_Contig_118_1 | 929 | 2483 |
| RFL 226 | Wheat-Rye-6R.300k_Assembly_Contig_101_1 | 930 | 2484 |
| RFL 226 | Wheat-Rye-6R.300k_Assembly_Contig_57_2 | 931 | 2485 |
| RFL 226 | R0934F.300k_Assembly_Contig_82_2 | 932 | 2486 |
| RFL 226 | Anapurna.300k_Assembly_Contig_95_1 | 933 | 2487 |
| RFL 226 | R0934F.300k_Assembly_Contig_98_1 | 934 | 2488 |
| RFL 226 | Primepii.300k_Assembly_Contig_68_2 | 935 | 2489 |
| RFL 226 | Anapurna.300k_Assembly_Contig_32_2 | 936 | 2490 |
| RFL 226 | R197.300k_Assembly_Contig_61_2 | 937 | 2491 |
| RFL 227 | R0934F.300k_Assembly_Contig_62_1 | 938 | 2492 |
| RFL 227 | Primepii.300k_Assembly_Contig_196_1 | 939 | 2493 |
| RFL 228 | R197.300k_Assembly_Contig_85_1 | 940 | 2494 |
| RFL 228 | Wheat-Rye-6R.300k_Assembly_Contig_68_1 | 941 | 2495 |
| RFL 228 | R0934F.300k_Assembly_Contig_94_1 | 942 | 2496 |
| RFL 228 | R0932E.300k_Assembly_Contig_97_1 | 943 | 2497 |
| RFL 228 | Anapurna.300k_Assembly_Contig_75_1 | 944 | 2498 |
| RFL 228 | Primepii.300k_Assembly_Contig_76_1 | 945 | 2499 |
| RFL 229 | R0932E.300k_Assembly_Contig_30_3 | 946 | 2500 |
| RFL 229 | R197.300k_Assembly_Contig_26_5 | 947 | 2501 |
| RFL 229 | Anapurna.300k_Assembly_Contig_26_4 | 948 | 2502 |
| RFL 229 | Wheat-Rye-6R.300k_Assembly_Contig_24_5 | 949 | 2503 |
| RFL 229 | Primepii.300k_Assembly_Contig_33_3 | 950 | 2504 |
| RFL 229 | R0934F.300k_Assembly_Contig_16_5 | 951 | 2505 |
| RFL 230 | R0932E.300k_Assembly_Contig_209_2 | 952 | 2506 |
| RFL 231 | R0932E.300k_Assembly_Contig_36_1 | 953 | 2507 |
| RFL 231 | R0934F.300k_Assembly_Contig_42_1 | 954 | 2508 |
| RFL 231 | R197.300k_Assembly_Contig_55_1 | 955 | 2509 |
| RFL 231 | Anapurna.300k_Assembly_Contig_44_1 | 956 | 2510 |
| RFL 231 | Wheat-Rye-6R.300k_Assembly_Contig_33_1 | 957 | 2511 |
| RFL 231 | Primepii.300k_Assembly_Contig_54_1 | 958 | 2512 |
| RFL 232 | R0932E.300k_Assembly_Contig_171_1 | 959 | 2513 |
| RFL 232 | Primepii.300k_Assembly_Contig_173_1 | 960 | 2514 |
| RFL 232 | Wheat-Rye-6R.300k_Assembly_Contig_168_1 | 961 | 2515 |
| RFL 232 | R197.300k_Assembly_Contig_177_1 | 962 | 2516 |
| RFL 232 | Anapurna.300k_Assembly_Contig_165_1 | 963 | 2517 |
| RFL 232 | R0934F.300k_Assembly_Contig_158_1 | 964 | 2518 |
| RFL 234 | Triticum-timopheevii.300k_Assembly_Contig_101_1 | 965 | 2519 |
| RFL 235 | Triticum-timopheevii.300k_Assembly_Contig_75_1 | 966 | 2520 |
| RFL 236 | R0934F.300k_Assembly_Contig_33_2 | 967 | 2521 |
| RFL 236 | R0932E.300k_Assembly_Contig_52_1 | 968 | 2522 |
| RFL 236 | Primepii.300k_Assembly_Contig_29_3 | 969 | 2523 |
| RFL 236 | Wheat-Rye-6R.300k_Assembly_Contig_38_1 | 970 | 2524 |
| RFL 236 | R197.300k_Assembly_Contig_50_2 | 971 | 2525 |
| RFL 236 | Anapurna.300k_Assembly_Contig_34_2 | 972 | 2526 |
| RFL 237 | R0934F.300k_Assembly_Contig_118_1 | 973 | 2527 |
| RFL 237 | Triticum-timopheevii.300k_Assembly_Contig_82_1 | 974 | 2528 |

TABLE 7-continued

| RFL-Name | Name | SEQID-PRT1 | SEQID-DNA |
|---|---|---|---|
| RFL 238 | Primepii.300k_Assembly_Contig_29_4 | 975 | 2529 |
| RFL 238 | R0934F.300k_Assembly_Contig_33_3 | 976 | 2530 |
| RFL 238 | Anapurna.300k_Assembly_Contig_34_3 | 977 | 2531 |
| RFL 238 | R0932E.300k_Assembly_Contig_52_2 | 978 | 2532 |
| RFL 238 | Wheat-Rye-6R.300k_Assembly_Contig_38_2 | 979 | 2533 |
| RFL 238 | R197.300k_Assembly_Contig_50_3 | 980 | 2534 |
| RFL 239 | Anapurna.300k_Assembly_Contig_92_1 | 981 | 2535 |
| RFL 239 | Wheat-Rye-6R.300k_Assembly_Contig_103_1 | 982 | 2536 |
| RFL 240 | Primepii.300k_Assembly_Contig_140_1 | 983 | 2537 |
| RFL 240 | R197.300k_Assembly_Contig_156_1 | 984 | 2538 |
| RFL 240 | R0932E.300k_Assembly_Contig_148_1 | 985 | 2539 |
| RFL 240 | R0934F.300k_Assembly_Contig_136_1 | 986 | 2540 |
| RFL 241 | Primepii.300k_Assembly_Contig_138_1 | 987 | 2541 |
| RFL 241 | Wheat-Rye-6R.300k_Assembly_Contig_134_2 | 988 | 2542 |
| RFL 241 | R197.300k_Assembly_Contig_164_2 | 989 | 2543 |
| RFL 241 | R0932E.300k_Assembly_Contig_143_1 | 990 | 2544 |
| RFL 241 | Anapurna.300k_Assembly_Contig_136_1 | 991 | 2545 |
| RFL 241 | R0934F.300k_Assembly_Contig_137_1 | 992 | 2546 |
| RFL 242 | Anapurna.300k_Assembly_Contig_72_1 | 993 | 2547 |
| RFL 243 | Anapurna.300k_Assembly_Contig_8_2 | 994 | 2548 |
| RFL 244 | Anapurna.300k_Assembly_Contig_164_1 | 995 | 2549 |
| RFL 245 | R0934F.300k_Assembly_Contig_58_1 | 996 | 2550 |
| RFL 245 | Anapurna.300k_Assembly_Contig_25_2 | 997 | 2551 |
| RFL 245 | R0932E.300k_Assembly_Contig_57_2 | 998 | 2552 |
| RFL 245 | Wheat-Rye-6R.300k_Assembly_Contig_46_2 | 999 | 2553 |
| RFL 245 | R197.300k_Assembly_Contig_45_2 | 1000 | 2554 |
| RFL 245 | Primepii.300k_Assembly_Contig_36_1 | 1001 | 2555 |
| RFL 245 | R0932E.300k_Assembly_Contig_219_2 | 1002 | 2556 |
| RFL 246 | Primepii.300k_Assembly_Contig_116_2 | 1003 | 2557 |
| RFL 246 | Anapurna.300k_Assembly_Contig_90_3 | 1004 | 2558 |
| RFL 246 | R197.300k_Assembly_Contig_125_2 | 1005 | 2559 |
| RFL 246 | Wheat-Rye-6R.300k_Assembly_Contig_102_2 | 1006 | 2560 |
| RFL 246 | R0934F.300k_Assembly_Contig_96_2 | 1007 | 2561 |
| RFL 246 | R0932E.300k_Assembly_Contig_125_2 | 1008 | 2562 |
| RFL 247 | R0932E.300k_Assembly_Contig_53_1 | 1009 | 2563 |
| RFL 247 | R0934F.300k_Assembly_Contig_26_1 | 1010 | 2564 |
| RFL 247 | Primepii.300k_Assembly_Contig_40_1 | 1011 | 2565 |
| RFL 247 | Anapurna.300k_Assembly_Contig_29_1 | 1012 | 2566 |
| RFL 247 | R197.300k_Assembly_Contig_36_1 | 1013 | 2567 |
| RFL 247 | Wheat-Rye-6R.300k_Assembly_Contig_28_1 | 1014 | 2568 |
| RFL 247 | Triticum-timopheevii.300k_Assembly_Contig_25_1 | 1015 | 2569 |
| RFL 248 | R0934F.300k_Assembly_Contig_183_1 | 1016 | 2570 |
| RFL 248 | Wheat-Rye-6R.300k_Assembly_Contig_176_1 | 1017 | 2571 |
| RFL 248 | R0932E.300k_Assembly_Contig_180_1 | 1018 | 2572 |
| RFL 249 | Anapurna.300k_Assembly_Contig_130_1 | 1019 | 2573 |
| RFL 249 | Wheat-Rye-6R.300k_Assembly_Contig_128_1 | 1020 | 2574 |
| RFL 249 | R197.300k_Assembly_Contig_144_1 | 1021 | 2575 |
| RFL 249 | R0934F.300k_Assembly_Contig_131_1 | 1022 | 2576 |
| RFL 249 | R0932E.300k_Assembly_Contig_137_1 | 1023 | 2577 |
| RFL 249 | Primepii.300k_Assembly_Contig_135_1 | 1024 | 2578 |
| RFL 250 | Wheat-Rye-6R.300k_Assembly_Contig_47_2 | 1025 | 2579 |
| RFL 250 | Primepii.300k_Assembly_Contig_69_2 | 1026 | 2580 |
| RFL 250 | R0932E.300k_Assembly_Contig_69_2 | 1027 | 2581 |
| RFL 250 | Anapurna.300k_Assembly_Contig_56_2 | 1028 | 2582 |
| RFL 250 | R0934F.300k_Assembly_Contig_59_2 | 1029 | 2583 |
| RFL 250 | R197.300k_Assembly_Contig_91_2 | 1030 | 2584 |
| RFL 251 | R197.300k_Assembly_Contig_26_6 | 1031 | 2585 |
| RFL 251 | Triticum-timopheevii.300k_Assembly_Contig_108_1 | 1032 | 2586 |
| RFL 251 | Anapurna.300k_Assembly_Contig_26_5 | 1033 | 2587 |
| RFL 251 | R0932E.300k_Assembly_Contig_30_4 | 1034 | 2588 |
| RFL 251 | Wheat-Rye-6R.300k_Assembly_Contig_24_6 | 1035 | 2589 |
| RFL 251 | Primepii.300k_Assembly_Contig_33_4 | 1036 | 2590 |
| RFL 251 | R0934F.300k_Assembly_Contig_16_6 | 1037 | 2591 |
| RFL 252 | Primepii.300k_Assembly_Contig_189_1 | 1038 | 2592 |
| RFL 252 | R0934F.300k_Assembly_Contig_169_1 | 1039 | 2593 |
| RFL 253 | Wheat-Rye-6R.300k_Assembly_Contig_112_2 | 1040 | 2594 |
| RFL 253 | R0932E.300k_Assembly_Contig_111_2 | 1041 | 2595 |
| RFL 253 | R0934F.300k_Assembly_Contig_130_2 | 1042 | 2596 |
| RFL 253 | Anapurna.300k_Assembly_Contig_88_2 | 1043 | 2597 |
| RFL 254 | R0932E.300k_Assembly_Contig_119_2 | 1044 | 2598 |
| RFL 254 | R0934F.300k_Assembly_Contig_108_2 | 1045 | 2599 |
| RFL 254 | Triticum-timopheevii.300k_Assembly_Contig_77_2 | 1046 | 2600 |
| RFL 254 | R197.300k_Assembly_Contig_122_2 | 1047 | 2601 |
| RFL 254 | Wheat-Rye-6R.300k_Assembly_Contig_116_2 | 1048 | 2602 |
| RFL 254 | Anapurna.300k_Assembly_Contig_103_2 | 1049 | 2603 |

TABLE 7-continued

| RFL-Name | Name | SEQID-PRT1 | SEQID-DNA |
|---|---|---|---|
| RFL 254 | Primepii.300k_Assembly_Contig_101_2 | 1050 | 2604 |
| RFL 255 | R0934F.300k_Assembly_Contig_212_1 | 1051 | 2605 |
| RFL 256 | Wheat-Rye-6R.300k_Assembly_Contig_76_1 | 1052 | 2606 |
| RFL 256 | R0934F.300k_Assembly_Contig_79_1 | 1053 | 2607 |
| RFL 256 | Triticum-timopheevii.300k_Assembly_Contig_32_1 | 1054 | 2608 |
| RFL 256 | R0932E.300k_Assembly_Contig_81_1 | 1055 | 2609 |
| RFL 256 | Anapurna.300k_Assembly_Contig_67_1 | 1056 | 2610 |
| RFL 256 | Primepii.300k_Assembly_Contig_89_1 | 1057 | 2611 |
| RFL 256 | R197.300k_Assembly_Contig_74_1 | 1058 | 2612 |
| RFL 257 | Primepii.300k_Assembly_Contig_71_1 | 1059 | 2613 |
| RFL 257 | Wheat-Rye-6R.300k_Assembly_Contig_78_1 | 1060 | 2614 |
| RFL 257 | R0932E.300k_Assembly_Contig_101_1 | 1061 | 2615 |
| RFL 257 | R0934F.300k_Assembly_Contig_85_1 | 1062 | 2616 |
| RFL 257 | R197.300k_Assembly_Contig_76_1 | 1063 | 2617 |
| RFL 257 | Anapurna.300k_Assembly_Contig_79_1 | 1064 | 2618 |
| RFL 258 | Primepii.300k_Assembly_Contig_41_1 | 1065 | 2619 |
| RFL 259 | Triticum-timopheevii.300k_Assembly_Contig_76_2 | 1066 | 2620 |
| RFL 260 | Anapurna.300k_Assembly_Contig_155_1 | 1067 | 2621 |
| RFL 260 | R0932E.300k_Assembly_Contig_163_2 | 1068 | 2622 |
| RFL 260 | R0934F.300k_Assembly_Contig_160_1 | 1069 | 2623 |
| RFL 260 | Wheat-Rye-6R.300k_Assembly_Contig_162_1 | 1070 | 2624 |
| RFL 260 | R197.300k_Assembly_Contig_171_1 | 1071 | 2625 |
| RFL 260 | Primepii.300k_Assembly_Contig_146_1 | 1072 | 2626 |
| RFL 261 | Triticum-timopheevii.300k_Assembly_Contig_90_2 | 1073 | 2627 |
| RFL 262 | Primepii.300k_Assembly_Contig_172_1 | 1074 | 2628 |
| RFL 262 | Wheat-Rye-6R.300k_Assembly_Contig_159_1 | 1075 | 2629 |
| RFL 262 | R197.300k_Assembly_Contig_167_1 | 1076 | 2630 |
| RFL 263 | R197.300k_Assembly_Contig_126_1 | 1077 | 2631 |
| RFL 263 | Wheat-Rye-6R.300k_Assembly_Contig_157_1 | 1078 | 2632 |
| RFL 263 | Wheat-Rye-6R.300k_Assembly_Contig_189_1 | 1079 | 2633 |
| RFL 263 | R0932E.300k_Assembly_Contig_132_1 | 1080 | 2634 |
| RFL 263 | Anapurna.300k_Assembly_Contig_114_1 | 1081 | 2635 |
| RFL 264 | Triticum-timopheevii.300k_Assembly_Contig_64_1 | 1082 | 2636 |
| RFL 265 | R197.300k_Assembly_Contig_129_1 | 1083 | 2637 |
| RFL 265 | R0934F.300k_Assembly_Contig_120_1 | 1084 | 2638 |
| RFL 265 | Wheat-Rye-6R.300k_Assembly_Contig_118_1 | 1085 | 2639 |
| RFL 265 | Anapurna.300k_Assembly_Contig_102_1 | 1086 | 2640 |
| RFL 265 | Triticum-timopheevii.300k_Assembly_Contig_79_1 | 1087 | 2641 |
| RFL 265 | Primepii.300k_Assembly_Contig_123_1 | 1088 | 2642 |
| RFL 265 | R0932E.300k_Assembly_Contig_127_1 | 1089 | 2643 |
| RFL 266 | Triticum-timopheevii.300k_Assembly_Contig_17_2 | 1090 | 2644 |
| RFL 267 | Triticum-timopheevii.300k_Assembly_Contig_90_3 | 1091 | 2645 |
| RFL 268 | R197.300k_Assembly_Contig_90_4 | 1092 | 2646 |
| RFL 268 | Triticum-timopheevii.300k_Assembly_Contig_52_4 | 1093 | 2647 |
| RFL 268 | R0934F.300k_Assembly_Contig_92_4 | 1094 | 2648 |
| RFL 268 | R0932E.300k_Assembly_Contig_109_4 | 1095 | 2649 |
| RFL 269 | Triticum-timopheevii.300k_Assembly_Contig_84_2 | 1096 | 2650 |
| RFL 270 | Triticum-timopheevii.300k_Assembly_Contig_56_1 | 1097 | 2651 |
| RFL 271 | R0932E.300k_Assembly_Contig_167_1 | 1098 | 2652 |
| RFL 272 | Triticum-timopheevii.300k_Assembly_Contig_17_1 | 1099 | 2653 |
| RFL 273 | Primepii.300k_Assembly_Contig_84_2 | 1100 | 2654 |
| RFL 273 | R0932E.300k_Assembly_Contig_212_2 | 1101 | 2655 |
| RFL 273 | R0934F.300k_Assembly_Contig_62_2 | 1102 | 2656 |
| RFL 274 | Triticum-timopheevii.300k_Assembly_Contig_87_1 | 1103 | 2657 |
| RFL 275 | Anapurna.300k_Assembly_Contig_208_1 | 1104 | 2658 |
| RFL 276 | R0934F.300k_Assembly_Contig_42_2 | 1105 | 2659 |
| RFL 276 | R197.300k_Assembly_Contig_55_2 | 1106 | 2660 |
| RFL 276 | R0932E.300k_Assembly_Contig_36_2 | 1107 | 2661 |
| RFL 276 | Primepii.300k_Assembly_Contig_54_2 | 1108 | 2662 |
| RFL 276 | Wheat-Rye-6R.300k_Assembly_Contig_33_2 | 1109 | 2663 |
| RFL 276 | Anapurna.300k_Assembly_Contig_44_2 | 1110 | 2664 |
| RFL 277 | Triticum-timopheevii.300k_Assembly_Contig_2_1 | 1111 | 2665 |
| RFL 277 | R0934F.300k_Assembly_Contig_3_1 | 1112 | 2666 |
| RFL 278 | Triticum-timopheevii.300k_Assembly_Contig_85_2 | 1113 | 2667 |

TABLE 7-continued

| RFL-Name | Name | SEQID-PRT1 | SEQID-DNA |
|---|---|---|---|
| RFL 279 | Wheat-Rye-6R.300k_Assembly_Contig_56_2 | 1114 | 2668 |
| RFL 279 | R0934F.300k_Assembly_Contig_60_2 | 1115 | 2669 |
| RFL 279 | Anapurna.300k_Assembly_Contig_60_3 | 1116 | 2670 |
| RFL 279 | Primepii.300k_Assembly_Contig_56_3 | 1117 | 2671 |
| RFL 279 | R197.300k_Assembly_Contig_60_2 | 1118 | 2672 |
| RFL 279 | R0932E.300k_Assembly_Contig_2_2 | 1119 | 2673 |
| RFL 280 | R0934F.300k_Assembly_Contig_129_1 | 1120 | 2674 |
| RFL 280 | R197.300k_Assembly_Contig_139_1 | 1121 | 2675 |
| RFL 280 | Anapurna.300k_Assembly_Contig_129_1 | 1122 | 2676 |
| RFL 280 | Wheat-Rye-6R.300k_Assembly_Contig_127_1 | 1123 | 2677 |
| RFL 280 | Primepii.300k_Assembly_Contig_136_2 | 1124 | 2678 |
| RFL 280 | R0932E.300k_Assembly_Contig_138_1 | 1125 | 2679 |
| RFL 281 | Triticum-timopheevii.300k_Assembly_Contig_23_2 | 1126 | 2680 |
| RFL 282 | R197.300k_Assembly_Contig_181_1 | 1127 | 2681 |
| RFL 282 | Wheat-Rye-6R.300k_Assembly_Contig_186_1 | 1128 | 2682 |
| RFL 282 | R0932E.300k_Assembly_Contig_95_2 | 1129 | 2683 |
| RFL 282 | Primepii.300k_Assembly_Contig_177_1 | 1130 | 2684 |
| RFL 282 | R0934F.300k_Assembly_Contig_155_1 | 1131 | 2685 |
| RFL 282 | Wheat-Rye-6R.300k_Assembly_Contig_119_1 | 1132 | 2686 |
| RFL 282 | R197.300k_Assembly_Contig_106_1 | 1133 | 2687 |
| RFL 282 | Primepii.300k_Assembly_Contig_161_1 | 1134 | 2688 |
| RFL 282 | Anapurna.300k_Assembly_Contig_160_1 | 1135 | 2689 |
| RFL 282 | R197.300k_Assembly_Contig_219_1 | 1136 | 2690 |
| RFL 282 | Anapurna.300k_Assembly_Contig_198_1 | 1137 | 2691 |
| RFL 282 | Anapurna.300k_Assembly_Contig_100_1 | 1138 | 2692 |
| RFL 282 | Wheat-Rye-6R.300k_Assembly_Contig_170_1 | 1139 | 2693 |
| RFL 283 | R0934F.300k_Assembly_Contig_79_2 | 1140 | 2694 |
| RFL 283 | Wheat-Rye-6R.300k_Assembly_Contig_76_2 | 1141 | 2695 |
| RFL 283 | Triticum-timopheevii.300k_Assembly_Contig_32_2 | 1142 | 2696 |
| RFL 283 | Primepii.300k_Assembly_Contig_89_2 | 1143 | 2697 |
| RFL 283 | R197.300k_Assembly_Contig_74_2 | 1144 | 2698 |
| RFL 283 | R0932E.300k_Assembly_Contig_81_2 | 1145 | 2699 |
| RFL 283 | Anapurna.300k_Assembly_Contig_67_2 | 1146 | 2700 |
| RFL 284 | Primepii.300k_Assembly_Contig_84_1 | 1147 | 2701 |
| RFL 285 | Primepii.300k_Assembly_Contig_111_2 | 1148 | 2702 |
| RFL 286 | Triticum-timopheevii.300k_Assembly_Contig_55_2 | 1149 | 2703 |
| RFL 287 | Anapurna.300k_Assembly_Contig_154_2 | 1150 | 2704 |
| RFL 287 | Wheat-Rye-6R.300k_Assembly_Contig_142_2 | 1151 | 2705 |
| RFL 287 | R197.300k_Assembly_Contig_153_2 | 1152 | 2706 |
| RFL 287 | Primepii.300k_Assembly_Contig_158_2 | 1153 | 2707 |
| RFL 288 | Primepii.300k_Assembly_Contig_60_1 | 1154 | 2708 |
| RFL 288 | R0934F.300k_Assembly_Contig_67_1 | 1155 | 2709 |
| RFL 289 | R0932E.300k_Assembly_Contig_206_2 | 1156 | 2710 |
| RFL 290 | R0932E.300k_Assembly_Contig_166_2 | 1157 | 2711 |
| RFL 290 | R0934F.300k_Assembly_Contig_166_2 | 1158 | 2712 |
| RFL 290 | Primepii.300k_Assembly_Contig_174_2 | 1159 | 2713 |
| RFL 290 | R197.300k_Assembly_Contig_174_2 | 1160 | 2714 |
| RFL 290 | Anapurna.300k_Assembly_Contig_161_2 | 1161 | 2715 |
| RFL 290 | Wheat-Rye-6R.300k_Assembly_Contig_161_2 | 1162 | 2716 |
| RFL 291 | Anapurna.300k_Assembly_Contig_27_2 | 1163 | 2717 |
| RFL 291 | R0932E.300k_Assembly_Contig_9_2 | 1164 | 2718 |
| RFL 291 | Wheat-Rye-6R.300k_Assembly_Contig_4_3 | 1165 | 2719 |
| RFL 292 | Triticum-timopheevii.300k_Assembly_Contig_68_2 | 1166 | 2720 |
| RFL 293 | R197.300k_Assembly_Contig_73_1 | 1167 | 2721 |
| RFL 294 | Primepii.300k_Assembly_Contig_116_1 | 1168 | 2722 |
| RFL 294 | Wheat-Rye-6R.300k_Assembly_Contig_102_1 | 1169 | 2723 |
| RFL 294 | Anapurna.300k_Assembly_Contig_90_2 | 1170 | 2724 |
| RFL 294 | R197.300k_Assembly_Contig_125_1 | 1171 | 2725 |
| RFL 294 | R0934F.300k_Assembly_Contig_96_1 | 1172 | 2726 |
| RFL 294 | R0932E.300k_Assembly_Contig_125_1 | 1173 | 2727 |
| RFL 295 | Triticum-timopheevii.300k_Assembly_Contig_112_1 | 1174 | 2728 |
| RFL 296 | R197.300k_Assembly_Contig_159_1 | 1175 | 2729 |
| RFL 296 | Wheat-Rye-6R.300k_Assembly_Contig_146_1 | 1176 | 2730 |
| RFL 296 | Primepii.300k_Assembly_Contig_154_1 | 1177 | 2731 |
| RFL 296 | R0934F.300k_Assembly_Contig_144_1 | 1178 | 2732 |
| RFL 296 | Anapurna.300k_Assembly_Contig_152_1 | 1179 | 2733 |
| RFL 296 | R0932E.300k_Assembly_Contig_149_1 | 1180 | 2734 |
| RFL 297 | R0932E.300k_Assembly_Contig_129_1 | 1181 | 2735 |
| RFL 297 | Anapurna.300k_Assembly_Contig_120_1 | 1182 | 2736 |
| RFL 297 | Primepii.300k_Assembly_Contig_129_1 | 1183 | 2737 |
| RFL 297 | R197.300k_Assembly_Contig_145_1 | 1184 | 2738 |
| RFL 297 | R0934F.300k_Assembly_Contig_121_1 | 1185 | 2739 |
| RFL 297 | Wheat-Rye-6R.300k_Assembly_Contig_129_1 | 1186 | 2740 |

TABLE 7-continued

| RFL-Name | Name | SEQID-PRT1 | SEQID-DNA |
|---|---|---|---|
| RFL 298 | Wheat-Rye-6R.300k_Assembly_Contig_120_1 | 1187 | 2741 |
| RFL 298 | Anapurna.300k_Assembly_Contig_110_1 | 1188 | 2742 |
| RFL 298 | R197.300k_Assembly_Contig_124_1 | 1189 | 2743 |
| RFL 298 | R0932E.300k_Assembly_Contig_124_1 | 1190 | 2744 |
| RFL 298 | Primepii.300k_Assembly_Contig_124_1 | 1191 | 2745 |
| RFL 298 | R0934F.300k_Assembly_Contig_127_1 | 1192 | 2746 |
| RFL 299 | R197.300k_Assembly_Contig_195_2 | 1193 | 2747 |
| RFL 299 | R0934F.300k_Assembly_Contig_192_1 | 1194 | 2748 |
| RFL 299 | Wheat-Rye-6R.300k_Assembly_Contig_192_1 | 1195 | 2749 |
| RFL 300 | Wheat-Rye-6R.300k_Assembly_Contig_111_2 | 1196 | 2750 |
| RFL 300 | R197.300k_Assembly_Contig_121_2 | 1197 | 2751 |
| RFL 300 | Primepii.300k_Assembly_Contig_113_2 | 1198 | 2752 |
| RFL 301 | Anapurna.300k_Assembly_Contig_69_3 | 1199 | 2753 |
| RFL 301 | Primepii.300k_Assembly_Contig_61_3 | 1200 | 2754 |
| RFL 301 | R197.300k_Assembly_Contig_48_3 | 1201 | 2755 |
| RFL 301 | R0934F.300k_Assembly_Contig_65_3 | 1202 | 2756 |
| RFL 301 | Wheat-Rye-6R.300k_Assembly_Contig_64_3 | 1203 | 2757 |
| RFL 301 | R0932E.300k_Assembly_Contig_70_3 | 1204 | 2758 |
| RFL 302 | Triticum-timopheevii.300k_Assembly_Contig_24_2 | 1205 | 2759 |
| RFL 303 | Wheat-Rye-6R.300k_Assembly_Contig_199_1 | 1206 | 2760 |
| RFL 303 | Anapurna.300k_Assembly_Contig_195_1 | 1207 | 2761 |
| RFL 304 | Anapurna.300k_Assembly_Contig_120_2 | 1208 | 2762 |
| RFL 304 | R0932E.300k_Assembly_Contig_129_2 | 1209 | 2763 |
| RFL 304 | Primepii.300k_Assembly_Contig_129_2 | 1210 | 2764 |
| RFL 304 | R197.300k_Assembly_Contig_145_2 | 1211 | 2765 |
| RFL 304 | Wheat-Rye-6R.300k_Assembly_Contig_129_2 | 1212 | 2766 |
| RFL 304 | R0934F.300k_Assembly_Contig_121_2 | 1213 | 2767 |
| RFL 305 | Wheat-Rye-6R.300k_Assembly_Contig_135_1 | 1214 | 2768 |
| RFL 306 | R197.300k_Assembly_Contig_107_2 | 1215 | 2769 |
| RFL 306 | R0934F.300k_Assembly_Contig_88_2 | 1216 | 2770 |
| RFL 306 | Anapurna.300k_Assembly_Contig_76_2 | 1217 | 2771 |
| RFL 306 | Primepii.300k_Assembly_Contig_74_2 | 1218 | 2772 |
| RFL 306 | R0932E.300k_Assembly_Contig_115_2 | 1219 | 2773 |
| RFL 306 | Wheat-Rye-6R.300k_Assembly_Contig_81_2 | 1220 | 2774 |
| RFL 307 | Triticum-timopheevii.300k_Assembly_Contig_104_1 | 1221 | 2775 |
| RFL 308 | R197.300k_Assembly_Contig_198_1 | 1222 | 2776 |
| RFL 308 | R0932E.300k_Assembly_Contig_178_2 | 1223 | 2777 |
| RFL 308 | Wheat-Rye-6R.300k_Assembly_Contig_193_1 | 1224 | 2778 |
| RFL 308 | Anapurna.300k_Assembly_Contig_183_1 | 1225 | 2779 |
| RFL 308 | R0934F.300k_Assembly_Contig_175_1 | 1226 | 2780 |
| RFL 308 | Primepii.300k_Assembly_Contig_198_1 | 1227 | 2781 |
| RFL 309 | Wheat-Rye-6R.300k_Assembly_Contig_52_2 | 1228 | 2782 |
| RFL 309 | Primepii.300k_Assembly_Contig_194_1 | 1229 | 2783 |
| RFL 309 | R0932E.300k_Assembly_Contig_51_1 | 1230 | 2784 |
| RFL 309 | R0934F.300k_Assembly_Contig_191_2 | 1231 | 2785 |
| RFL 309 | R197.300k_Assembly_Contig_190_2 | 1232 | 2786 |
| RFL 310 | Triticum-timopheevii.300k_Assembly_Contig_19_1 | 1233 | 2787 |
| RFL 311 | Wheat-Rye-6R.300k_Assembly_Contig_123_1 | 1234 | 2788 |
| RFL 311 | Anapurna.300k_Assembly_Contig_118_1 | 1235 | 2789 |
| RFL 311 | R197.300k_Assembly_Contig_131_1 | 1236 | 2790 |
| RFL 311 | R0932E.300k_Assembly_Contig_128_1 | 1237 | 2791 |
| RFL 312 | Anapurna.300k_Assembly_Contig_146_1 | 1238 | 2792 |
| RFL 312 | R0932E.300k_Assembly_Contig_175_1 | 1239 | 2793 |
| RFL 312 | Wheat-Rye-6R.300k_Assembly_Contig_158_1 | 1240 | 2794 |
| RFL 312 | R197.300k_Assembly_Contig_155_1 | 1241 | 2795 |
| RFL 312 | R0934F.300k_Assembly_Contig_153_1 | 1242 | 2796 |
| RFL 312 | Primepii.300k_Assembly_Contig_145_1 | 1243 | 2797 |
| RFL 313 | R0934F.300k_Assembly_Contig_59_1 | 1244 | 2798 |
| RFL 313 | R0932E.300k_Assembly_Contig_69_1 | 1245 | 2799 |
| RFL 313 | Wheat-Rye-6R.300k_Assembly_Contig_47_1 | 1246 | 2800 |
| RFL 313 | Primepii.300k_Assembly_Contig_69_1 | 1247 | 2801 |
| RFL 313 | Anapurna.300k_Assembly_Contig_56_1 | 1248 | 2802 |
| RFL 313 | R197.300k_Assembly_Contig_91_1 | 1249 | 2803 |
| RFL 314 | Anapurna.300k_Assembly_Contig_143_2 | 1250 | 2804 |
| RFL 314 | R197.300k_Assembly_Contig_169_2 | 1251 | 2805 |
| RFL 314 | R0932E.300k_Assembly_Contig_150_2 | 1252 | 2806 |
| RFL 314 | Wheat-Rye-6R.300k_Assembly_Contig_148_2 | 1253 | 2807 |
| RFL 314 | Primepii.300k_Assembly_Contig_147_2 | 1254 | 2808 |
| RFL 314 | R0934F.300k_Assembly_Contig_148_2 | 1255 | 2809 |
| RFL 315 | R197.300k_Assembly_Contig_129_2 | 1256 | 2810 |
| RFL 315 | R0934F.300k_Assembly_Contig_120_2 | 1257 | 2811 |
| RFL 315 | Wheat-Rye-6R.300k_Assembly_Contig_118_2 | 1258 | 2812 |
| RFL 315 | Primepii.300k_Assembly_Contig_123_2 | 1259 | 2813 |

TABLE 7-continued

| RFL-Name | Name | SEQID-PRT1 | SEQID-DNA |
|---|---|---|---|
| RFL 315 | Anapurna.300k_Assembly_Contig_102_2 | 1260 | 2814 |
| RFL 315 | Triticum-timopheevii.300k_Assembly_Contig_79_2 | 1261 | 2815 |
| RFL 315 | R0932E.300k_Assembly_Contig_127_2 | 1262 | 2816 |
| RFL 316 | R197.300k_Assembly_Contig_208_2 | 1263 | 2817 |
| RFL 317 | R197.300k_Assembly_Contig_9_2 | 1264 | 2818 |
| RFL 317 | Anapurna.300k_Assembly_Contig_18_2 | 1265 | 2819 |
| RFL 317 | Primepii.300k_Assembly_Contig_5_2 | 1266 | 2820 |
| RFL 317 | R0934F.300k_Assembly_Contig_19_2 | 1267 | 2821 |
| RFL 317 | Wheat-Rye-6R.300k_Assembly_Contig_14_2 | 1268 | 2822 |
| RFL 317 | R0932E.300k_Assembly_Contig_16_2 | 1269 | 2823 |
| RFL 318 | Anapurna.300k_Assembly_Contig_57_1 | 1270 | 2824 |
| RFL 319 | Primepii.300k_Assembly_Contig_117_1 | 1271 | 2825 |
| RFL 319 | R0934F.300k_Assembly_Contig_123_1 | 1272 | 2826 |
| RFL 320 | R0932E.300k_Assembly_Contig_105_2 | 1273 | 2827 |
| RFL 320 | Wheat-Rye-6R.300k_Assembly_Contig_110_2 | 1274 | 2828 |
| RFL 320 | Anapurna.300k_Assembly_Contig_91_2 | 1275 | 2829 |
| RFL 320 | R197.300k_Assembly_Contig_87_2 | 1276 | 2830 |
| RFL 320 | R0934F.300k_Assembly_Contig_101_2 | 1277 | 2831 |
| RFL 320 | Primepii.300k_Assembly_Contig_98_2 | 1278 | 2832 |
| RFL 321 | R0934F.300k_Assembly_Contig_105_2 | 1279 | 2833 |
| RFL 321 | R0932E.300k_Assembly_Contig_84_2 | 1280 | 2834 |
| RFL 321 | Wheat-Rye-6R.300k_Assembly_Contig_89_2 | 1281 | 2835 |
| RFL 321 | R197.300k_Assembly_Contig_89_2 | 1282 | 2836 |
| RFL 321 | Primepii.300k_Assembly_Contig_78_2 | 1283 | 2837 |
| RFL 321 | Anapurna.300k_Assembly_Contig_65_2 | 1284 | 2838 |
| RFL 322 | R0934F.300k_Assembly_Contig_47_1 | 1285 | 2839 |
| RFL 322 | Primepii.300k_Assembly_Contig_15_1 | 1286 | 2840 |
| RFL 323 | R0932E.300k_Assembly_Contig_21_1 | 1287 | 2841 |
| RFL 323 | R0934F.300k_Assembly_Contig_25_1 | 1288 | 2842 |
| RFL 323 | R197.300k_Assembly_Contig_14_1 | 1289 | 2843 |
| RFL 323 | Anapurna.300k_Assembly_Contig_6_1 | 1290 | 2844 |
| RFL 323 | Primepii.300k_Assembly_Contig_20_1 | 1291 | 2845 |
| RFL 323 | Wheat-Rye-6R.300k_Assembly_Contig_8_1 | 1292 | 2846 |
| RFL 324 | Anapurna.300k_Assembly_Contig_178_1 | 1293 | 2847 |
| RFL 324 | Triticum-timopheevii.300k_Assembly_Contig_116_1 | 1294 | 2848 |
| RFL 324 | R197.300k_Assembly_Contig_193_1 | 1295 | 2849 |
| RFL 324 | R0932E.300k_Assembly_Contig_191_1 | 1296 | 2850 |
| RFL 324 | Wheat-Rye-6R.300k_Assembly_Contig_184_1 | 1297 | 2851 |
| RFL 324 | Primepii.300k_Assembly_Contig_186_1 | 1298 | 2852 |
| RFL 324 | R0934F.300k_Assembly_Contig_188_1 | 1299 | 2853 |
| RFL 325 | Primepii.300k_Assembly_Contig_74_1 | 1300 | 2854 |
| RFL 325 | R197.300k_Assembly_Contig_107_1 | 1301 | 2855 |
| RFL 325 | Wheat-Rye-6R.300k_Assembly_Contig_81_1 | 1302 | 2856 |
| RFL 325 | R0934F.300k_Assembly_Contig_88_1 | 1303 | 2857 |
| RFL 325 | R0932E.300k_Assembly_Contig_115_1 | 1304 | 2858 |
| RFL 325 | Anapurna.300k_Assembly_Contig_76_1 | 1305 | 2859 |
| RFL 326 | R0932E.300k_Assembly_Contig_77_1 | 1306 | 2860 |
| RFL 326 | Wheat-Rye-6R.300k_Assembly_Contig_75_1 | 1307 | 2861 |
| RFL 326 | R197.300k_Assembly_Contig_103_1 | 1308 | 2862 |
| RFL 326 | R0934F.300k_Assembly_Contig_72_1 | 1309 | 2863 |
| RFL 327 | Primepii.300k_Assembly_Contig_192_1 | 1310 | 2864 |
| RFL 327 | R197.300k_Assembly_Contig_1921 | 1311 | 2865 |
| RFL 327 | Wheat-Rye-6R.300k_Assembly_Contig_187_1 | 1312 | 2866 |
| RFL 327 | R0932E.300k_Assembly_Contig_190_1 | 1313 | 2867 |
| RFL 327 | R0934F.300k_Assembly_Contig_185_1 | 1314 | 2868 |
| RFL 327 | Anapurna.300k_Assembly_Contig_182_1 | 1315 | 2869 |
| RFL 328 | Primepii.300k_Assembly_Contig_95_1 | 1316 | 2870 |
| RFL 328 | R197.300k_Assembly_Contig_112_1 | 1317 | 2871 |
| RFL 328 | Wheat-Rye-6R.300k_Assembly_Contig_173_1 | 1318 | 2872 |
| RFL 329 | Triticum-timopheevii.300k_Assembly_Contig_88_2 | 1319 | 2873 |
| RFL 329 | Wheat-Rye-6R.300k_Assembly_Contig_124_1 | 1320 | 2874 |
| RFL 329 | Anapurna.300k_Assembly_Contig_115_1 | 1321 | 2875 |
| RFL 329 | Primepii.300k_Assembly_Contig_122_1 | 1322 | 2876 |
| RFL 329 | R197.300k_Assembly_Contig_130_1 | 1323 | 2877 |
| RFL 329 | R0934F.300k_Assembly_Contig_114_1 | 1324 | 2878 |
| RFL 330 | Wheat-Rye-6R.300k_Assembly_Contig_141_2 | 1325 | 2879 |
| RFL 330 | R197.300k_Assembly_Contig_146_2 | 1326 | 2880 |
| RFL 330 | Primepii.300k_Assembly_Contig_155_1 | 1327 | 2881 |
| RFL 330 | Anapurna.300k_Assembly_Contig_138_2 | 1328 | 2882 |
| RFL 330 | Triticum-timopheevii.300k_Assembly_Contig_92_1 | 1329 | 2883 |
| RFL 330 | R0934F.300k_Assembly_Contig_142_2 | 1330 | 2884 |
| RFL 330 | R0932E.300k_Assembly_Contig_146_2 | 1331 | 2885 |
| RFL 331 | R0932E.300k_Assembly_Contig_26_1 | 1332 | 2886 |
| RFL 331 | R197.300k_Assembly_Contig_41_1 | 1333 | 2887 |

TABLE 7-continued

| RFL-Name | Name | SEQID-PRT1 | SEQID-DNA |
|---|---|---|---|
| RFL 331 | R0934F.300k_Assembly_Contig_38_1 | 1334 | 2888 |
| RFL 331 | Wheat-Rye-6R.300k_Assembly_Contig_50_1 | 1335 | 2889 |
| RFL 331 | Primepii.300k_Assembly_Contig_45_1 | 1336 | 2890 |
| RFL 331 | Anapurna.300k_Assembly_Contig_45_1 | 1337 | 2891 |
| RFL 332 | Triticum-timopheevii.300k_Assembly_Contig_72_1 | 1338 | 2892 |
| RFL 333 | R0934F.300k_Assembly_Contig_53_2 | 1339 | 2893 |
| RFL 333 | Primepii.300k_Assembly_Contig_28_2 | 1340 | 2894 |
| RFL 333 | Wheat-Rye-6R.300k_Assembly_Contig_49_2 | 1341 | 2895 |
| RFL 333 | R0932E.300k_Assembly_Contig_14_2 | 1342 | 2896 |
| RFL 333 | R197.300k_Assembly_Contig_53_2 | 1343 | 2897 |
| RFL 333 | Anapurna.300k_Assembly_Contig_55_2 | 1344 | 2898 |
| RFL 334 | R197.300k_Assembly_Contig_208_1 | 1345 | 2899 |
| RFL 335 | Wheat-Rye-6R.300k_Assembly_Contig_112_1 | 1346 | 2900 |
| RFL 335 | R0934F.300k_Assembly_Contig_130_1 | 1347 | 2901 |
| RFL 335 | R0932E.300k_Assembly_Contig_111_1 | 1348 | 2902 |
| RFL 335 | Anapurna.300k_Assembly_Contig_88_1 | 1349 | 2903 |
| RFL 335 | R0932E.300k_Assembly_Contig_206_1 | 1350 | 2904 |
| RFL 336 | Triticum-timopheevii.300k_Assembly_Contig_18_1 | 1351 | 2905 |
| RFL 337 | R197.300k_Assembly_Contig_184_1 | 1352 | 2906 |
| RFL 337 | Triticum-timopheevii.300k_Assembly_Contig_115_1 | 1353 | 2907 |
| RFL 337 | R0932E.300k_Assembly_Contig_188_1 | 1354 | 2908 |
| RFL 337 | Primepii.300k_Assembly_Contig_185_1 | 1355 | 2909 |
| RFL 337 | R0934F.300k_Assembly_Contig_186_1 | 1356 | 2910 |
| RFL 337 | Anapurna.300k_Assembly_Contig_173_1 | 1357 | 2911 |
| RFL 337 | Wheat-Rye-6R.300k_Assembly_Contig_182_1 | 1358 | 2912 |
| RFL 338 | Primepii.300k_Assembly_Contig_111_1 | 1359 | 2913 |
| RFL 339 | Anapurna.300k_Assembly_Contig_36_2 | 1360 | 2914 |
| RFL 339 | Wheat-Rye-6R.300k_Assembly_Contig_43_2 | 1361 | 2915 |
| RFL 339 | R0934F.300k_Assembly_Contig_35_2 | 1362 | 2916 |
| RFL 339 | R197.300k_Assembly_Contig_2_5 | 1363 | 2917 |
| RFL 339 | R0932E.300k_Assembly_Contig_49_2 | 1364 | 2918 |
| RFL 339 | Primepii.300k_Assembly_Contig_32_2 | 1365 | 2919 |
| RFL 340 | Triticum-timopheevii.300k_Assembly_Contig_91_1 | 1366 | 2920 |
| RFL 341 | R0932E.300k_Assembly_Contig_118_1 | 1367 | 2921 |
| RFL 341 | R197.300k_Assembly_Contig_104_1 | 1368 | 2922 |
| RFL 341 | Anapurna.300k_Assembly_Contig_97_1 | 1369 | 2923 |
| RFL 341 | Wheat-Rye-6R.300k_Assembly_Contig_94_1 | 1370 | 2924 |
| RFL 342 | Triticum-timopheevii.300k_Assembly_Contig_11_1 | 1371 | 2925 |
| RFL 343 | Primepii.300k_Assembly_Contig_179_1 | 1372 | 2926 |
| RFL 344 | Triticum-timopheevii.300k_Assembly_Contig_128_1 | 1373 | 2927 |
| RFL 345 | R0932E.300k_Assembly_Contig_120_1 | 1374 | 2928 |
| RFL 346 | Wheat-Rye-6R.300k_Assembly_Contig_142_1 | 1375 | 2929 |
| RFL 346 | R197.300k_Assembly_Contig_153_1 | 1376 | 2930 |
| RFL 346 | Primepii.300k_Assembly_Contig_158_1 | 1377 | 2931 |
| RFL 346 | Anapurna.300k_Assembly_Contig_154_1 | 1378 | 2932 |
| RFL 347 | Anapurna.300k_Assembly_Contig_9_2 | 1379 | 2933 |
| RFL 347 | R0932E.300k_Assembly_Contig_10_2 | 1380 | 2934 |
| RFL 347 | R0934F.300k_Assembly_Contig_21_2 | 1381 | 2935 |
| RFL 347 | Primepii.300k_Assembly_Contig_48_2 | 1382 | 2936 |
| RFL 347 | R197.300k_Assembly_Contig_2_2 | 1383 | 2937 |
| RFL 347 | Wheat-Rye-6R.300k_Assembly_Contig_20_2 | 1384 | 2938 |
| RFL 348 | Triticum-timopheevii.300k_Assembly_Contig_58_2 | 1385 | 2939 |
| RFL 349 | Primepii.300k_Assembly_Contig_45_2 | 1386 | 2940 |
| RFL 349 | R197.300k_Assembly_Contig_41_2 | 1387 | 2941 |
| RFL 349 | R0932E.300k_Assembly_Contig_26_2 | 1388 | 2942 |
| RFL 349 | R0934F.300k_Assembly_Contig_38_2 | 1389 | 2943 |
| RFL 349 | Anapurna.300k_Assembly_Contig_45_2 | 1390 | 2944 |
| RFL 349 | Wheat-Rye-6R.300k_Assembly_Contig_50_2 | 1391 | 2945 |
| RFL 350 | Anapurna.300k_Assembly_Contig_177_1 | 1392 | 2946 |
| RFL 350 | R0934F.300k_Assembly_Contig_184_1 | 1393 | 2947 |
| RFL 350 | R0932E.300k_Assembly_Contig_186_1 | 1394 | 2948 |
| RFL 350 | R197.300k_Assembly_Contig_187_1 | 1395 | 2949 |
| RFL 350 | Wheat-Rye-6R.300k_Assembly_Contig_181_1 | 1396 | 2950 |
| RFL 351 | R0934F.300k_Assembly_Contig_93_1 | 1397 | 2951 |
| RFL 351 | Primepii.300k_Assembly_Contig_88_1 | 1398 | 2952 |
| RFL 352 | Triticum-timopheevii.300k_Assembly_Contig_68_1 | 1399 | 2953 |
| RFL 353 | R197.300k_Assembly_Contig_138_2 | 1400 | 2954 |
| RFL 353 | Wheat-Rye-6R.300k_Assembly_Contig_122_2 | 1401 | 2955 |
| RFL 353 | Anapurna.300k_Assembly_Contig_119_2 | 1402 | 2956 |
| RFL 353 | Primepii.300k_Assembly_Contig_131_2 | 1403 | 2957 |

TABLE 7-continued

| RFL-Name | Name | SEQID-PRT1 | SEQID-DNA |
|---|---|---|---|
| RFL 353 | R0932E.300k_Assembly_Contig_131_2 | 1404 | 2958 |
| RFL 353 | R0934F.300k_Assembly_Contig_113_2 | 1405 | 2959 |
| RFL 354 | R0932E.300k_Assembly_Contig_106_1 | 1406 | 2960 |
| RFL 354 | Anapurna.300k_Assembly_Contig_81_1 | 1407 | 2961 |
| RFL 354 | R197.300k_Assembly_Contig_88_1 | 1408 | 2962 |
| RFL 354 | Wheat-Rye-6R.300k_Assembly_Contig_114_1 | 1409 | 2963 |
| RFL 354 | R0934F.300k_Assembly_Contig_112_1 | 1410 | 2964 |
| RFL 354 | Primepii.300k_Assembly_Contig_103_1 | 1411 | 2965 |
| RFL 355 | Anapurna.300k_Assembly_Contig_133_1 | 1412 | 2966 |
| RFL 356 | Triticum-timopheevii.300k_Assembly_Contig_91_2 | 1413 | 2967 |
| RFL 357 | Wheat-Rye-6R.300k_Assembly_Contig_56_1 | 1414 | 2968 |
| RFL 357 | Anapurna.300k_Assembly_Contig_60_2 | 1415 | 2969 |
| RFL 357 | Primepii.300k_Assembly_Contig_56_2 | 1416 | 2970 |
| RFL 357 | R0934F.300k_Assembly_Contig_60_1 | 1417 | 2971 |
| RFL 357 | R0932E.300k_Assembly_Contig_2_1 | 1418 | 2972 |
| RFL 357 | R197.300k_Assembly_Contig_60_1 | 1419 | 2973 |
| RFL 358 | R0934F.300k_Assembly_Contig_193_1 | 1420 | 2974 |
| RFL 358 | Wheat-Rye-6R.300k_Assembly_Contig_188_1 | 1421 | 2975 |
| RFL 358 | R197.300k_Assembly_Contig_197_1 | 1422 | 2976 |
| RFL 358 | Primepii.300k_Assembly_Contig_190_1 | 1423 | 2977 |
| RFL 358 | R0932E.300k_Assembly_Contig_194_1 | 1424 | 2978 |
| RFL 358 | Anapurna.300k_Assembly_Contig_184_1 | 1425 | 2979 |
| RFL 359 | Primepii.300k_Assembly_Contig_210_1 | 1426 | 2980 |
| RFL 359 | R0934F.300k_Assembly_Contig_208_1 | 1427 | 2981 |
| RFL 360 | Wheat-Rye-6R.300k_Assembly_Contig_153_1 | 1428 | 2982 |
| RFL 360 | R197.300k_Assembly_Contig_160_1 | 1429 | 2983 |
| RFL 361 | Wheat-Rye-6R.300k_Assembly_Contig_97_2 | 1430 | 2984 |
| RFL 361 | Primepii.300k_Assembly_Contig_91_2 | 1431 | 2985 |
| RFL 361 | R0932E.300k_Assembly_Contig_110_2 | 1432 | 2986 |
| RFL 361 | R0934F.300k_Assembly_Contig_86_2 | 1433 | 2987 |
| RFL 361 | Anapurna.300k_Assembly_Contig_101_2 | 1434 | 2988 |
| RFL 361 | R197.300k_Assembly_Contig_108_2 | 1435 | 2989 |
| RFL 362 | Triticum-timopheevii.300k_Assembly_Contig_61_1 | 1436 | 2990 |
| RFL 363 | R0932E.300k_Assembly_Contig_31_1 | 1437 | 2991 |
| RFL 363 | R197.300k_Assembly_Contig_49_1 | 1438 | 2992 |
| RFL 363 | R0934F.300k_Assembly_Contig_41_1 | 1439 | 2993 |
| RFL 363 | Anapurna.300k_Assembly_Contig_40_1 | 1440 | 2994 |
| RFL 363 | Wheat-Rye-6R.300k_Assembly_Contig_27_1 | 1441 | 2995 |
| RFL 363 | Primepii.300k_Assembly_Contig_65_1 | 1442 | 2996 |
| RFL 364 | Wheat-Rye-6R.300k_Assembly_Contig_141_3 | 1443 | 2997 |
| RFL 364 | R197.300k_Assembly_Contig_146_3 | 1444 | 2998 |
| RFL 364 | Triticum-timopheevii.300k_Assembly_Contig_92_2 | 1445 | 2999 |
| RFL 364 | Anapurna.300k_Assembly_Contig_138_3 | 1446 | 3000 |
| RFL 364 | R0934F.300k_Assembly_Contig_142_3 | 1447 | 3001 |
| RFL 364 | R0932E.300k_Assembly_Contig_146_3 | 1448 | 3002 |
| RFL 364 | Primepii.300k_Assembly_Contig_155_2 | 1449 | 3003 |
| RFL 365 | R0934F.300k_Assembly_Contig_5_3 | 1450 | 3004 |
| RFL 365 | Primepii.300k_Assembly_Contig_17_2 | 1451 | 3005 |
| RFL 365 | R197.300k_Assembly_Contig_5_2 | 1452 | 3006 |
| RFL 366 | Wheat-Rye-6R.300k_Assembly_Contig_144_1 | 1453 | 3007 |
| RFL 366 | Anapurna.300k_Assembly_Contig_148_1 | 1454 | 3008 |
| RFL 366 | Primepii.300k_Assembly_Contig_142_1 | 1455 | 3009 |
| RFL 366 | R0932E.300k_Assembly_Contig_147_1 | 1456 | 3010 |
| RFL 366 | R197.300k_Assembly_Contig_170_1 | 1457 | 3011 |
| RFL 366 | R0934F.300k_Assembly_Contig_168_1 | 1458 | 3012 |
| RFL 367 | R197.300k_Assembly_Contig_138_1 | 1459 | 3013 |
| RFL 367 | Wheat-Rye-6R.300k_Assembly_Contig_122_1 | 1460 | 3014 |
| RFL 367 | Anapurna.300k_Assembly_Contig_119_1 | 1461 | 3015 |
| RFL 367 | R0932E.300k_Assembly_Contig_131_1 | 1462 | 3016 |
| RFL 367 | Primepii.300k_Assembly_Contig_131_1 | 1463 | 3017 |
| RFL 367 | R0934F.300k_Assembly_Contig_113_1 | 1464 | 3018 |
| RFL 368 | R0932E.300k_Assembly_Contig_63_2 | 1465 | 3019 |
| RFL 368 | R197.300k_Assembly_Contig_35_2 | 1466 | 3020 |
| RFL 368 | Anapurna.300k_Assembly_Contig_170_2 | 1467 | 3021 |
| RFL 368 | Wheat-Rye-6R.300k_Assembly_Contig_61_2 | 1468 | 3022 |
| RFL 369 | Anapurna.300k_Assembly_Contig_159_1 | 1469 | 3023 |
| RFL 369 | R0932E.300k_Assembly_Contig_162_1 | 1470 | 3024 |
| RFL 369 | R197.300k_Assembly_Contig_165_1 | 1471 | 3025 |
| RFL 369 | Wheat-Rye-6R.300k_Assembly_Contig_138_1 | 1472 | 3026 |
| RFL 369 | R0934F.300k_Assembly_Contig_164_1 | 1473 | 3027 |
| RFL 369 | Primepii.300k_Assembly_Contig_168_1 | 1474 | 3028 |
| RFL 370 | R0932E.300k_Assembly_Contig_28_1 | 1475 | 3029 |
| RFL 370 | Primepii.300k_Assembly_Contig_26_1 | 1476 | 3030 |
| RFL 370 | Anapurna.300k_Assembly_Contig_7_1 | 1477 | 3031 |
| RFL 371 | Anapurna.300k_Assembly_Contig_117_1 | 1478 | 3032 |

TABLE 7-continued

| RFL-Name | Name | SEQID-PRT1 | SEQID-DNA |
|---|---|---|---|
| RFL 371 | R0932E.300k_Assembly_Contig_154_1 | 1479 | 3033 |
| RFL 371 | Primepii.300k_Assembly_Contig_134_1 | 1480 | 3034 |
| RFL 372 | R0932E.300k_Assembly_Contig_131_3 | 1481 | 3035 |
| RFL 372 | R0934F.300k_Assembly_Contig_113_3 | 1482 | 3036 |
| RFL 373 | Primepii.300k_Assembly_Contig_211_1 | 1483 | 3037 |
| RFL 373 | R197.300k_Assembly_Contig_206_1 | 1484 | 3038 |
| RFL 373 | R0934F.300k_Assembly_Contig_205_1 | 1485 | 3039 |
| RFL 374 | Triticum-timopheevii.300k_Assembly_Contig_103_2 | 1486 | 3040 |
| RFL 375 | R0932E.300k_Assembly_Contig_42_2 | 1487 | 3041 |
| RFL 375 | Anapurna.300k_Assembly_Contig_46_2 | 1488 | 3042 |
| RFL 375 | R197.300k_Assembly_Contig_147_2 | 1489 | 3043 |
| RFL 375 | Wheat-Rye-6R.300k_Assembly_Contig_18_2 | 1490 | 3044 |
| RFL 376 | R0932E.300k_Assembly_Contig_119_3 | 1491 | 3045 |
| RFL 376 | R197.300k_Assembly_Contig_122_3 | 1492 | 3046 |
| RFL 376 | R0934F.300k_Assembly_Contig_108_3 | 1493 | 3047 |
| RFL 376 | Wheat-Rye-6R.300k_Assembly_Contig_116_3 | 1494 | 3048 |
| RFL 376 | Anapurna.300k_Assembly_Contig_103_3 | 1495 | 3049 |
| RFL 376 | Primepii.300k_Assembly_Contig_101_3 | 1496 | 3050 |
| RFL 377 | R0932E.300k_Assembly_Contig_74_2 | 1497 | 3051 |
| RFL 378 | R197.300k_Assembly_Contig_202_1 | 1498 | 3052 |
| RFL 378 | R0932E.300k_Assembly_Contig_197_1 | 1499 | 3053 |
| RFL 378 | Wheat-Rye-6R.300k_Assembly_Contig_196_1 | 1500 | 3054 |
| RFL 378 | Anapurna.300k_Assembly_Contig_187_1 | 1501 | 3055 |
| RFL 378 | R0934F.300k_Assembly_Contig_199_1 | 1502 | 3056 |
| RFL 378 | Primepii.300k_Assembly_Contig_205_1 | 1503 | 3057 |
| RFL 379 | Primepii.300k_Assembly_Contig_223_1 | 1504 | 3058 |
| RFL 379 | Wheat-Rye-6R.300k_Assembly_Contig_179_1 | 1505 | 3059 |
| RFL 379 | Anapurna.300k_Assembly_Contig_193_1 | 1506 | 3060 |
| RFL 379 | R0932E.300k_Assembly_Contig_178_1 | 1507 | 3061 |
| RFL 380 | Triticum-timopheevii.300k_Assembly_Contig_85_1 | 1508 | 3062 |
| RFL 381 | R197.300k_Assembly_Contig_169_1 | 1509 | 3063 |
| RFL 381 | Wheat-Rye-6R.300k_Assembly_Contig_148_1 | 1510 | 3064 |
| RFL 381 | R0932E.300k_Assembly_Contig_150_1 | 1511 | 3065 |
| RFL 381 | Primepii.300k_Assembly_Contig_147_1 | 1512 | 3066 |
| RFL 381 | R0934F.300k_Assembly_Contig_148_1 | 1513 | 3067 |
| RFL 381 | Anapurna.300k_Assembly_Contig_143_1 | 1514 | 3068 |
| RFL 382 | Triticum-timopheevii.300k_Assembly_Contig_109_1 | 1515 | 3069 |
| RFL 383 | Wheat-Rye-6R.300k_Assembly_Contig_111_1 | 1516 | 3070 |
| RFL 383 | R197.300k_Assembly_Contig_121_1 | 1517 | 3071 |
| RFL 383 | Primepii.300k_Assembly_Contig_113_1 | 1518 | 3072 |
| RFL 384 | Triticum-timopheevii.300k_Assembly_Contig_117_1 | 1519 | 3073 |
| RFL 385 | Anapurna.300k_Assembly_Contig_167_1 | 1520 | 3074 |
| RFL 385 | R0932E.300k_Assembly_Contig_182_1 | 1521 | 3075 |
| RFL 385 | Wheat-Rye-6R.300k_Assembly_Contig_175_1 | 1522 | 3076 |
| RFL 385 | R0934F.300k_Assembly_Contig_172_1 | 1523 | 3077 |
| RFL 385 | Primepii.300k_Assembly_Contig_170_1 | 1524 | 3078 |
| RFL 385 | R197.300k_Assembly_Contig_175_1 | 1525 | 3079 |
| RFL 386 | Primepii.300k_Assembly_Contig_105_1 | 1526 | 3080 |
| RFL 386 | R0934F.300k_Assembly_Contig_56_1 | 1527 | 3081 |
| RFL 387 | Primepii.300k_Assembly_Contig_159_2 | 1528 | 3082 |
| RFL 388 | Wheat-Rye-6R.300k_Assembly_Contig_175_2 | 1529 | 3083 |
| RFL 388 | Anapurna.300k_Assembly_Contig_167_2 | 1530 | 3084 |
| RFL 388 | R0934F.300k_Assembly_Contig_172_2 | 1531 | 3085 |
| RFL 388 | Primepii.300k_Assembly_Contig_170_2 | 1532 | 3086 |
| RFL 388 | R0932E.300k_Assembly_Contig_182_2 | 1533 | 3087 |
| RFL 388 | R197.300k_Assembly_Contig_175_2 | 1534 | 3088 |
| RFL 389 | R0934F.300k_Assembly_Contig_74_1 | 1535 | 3089 |
| RFL 389 | Anapurna.300k_Assembly_Contig_64_1 | 1536 | 3090 |
| RFL 389 | Wheat-Rye-6R.300k_Assembly_Contig_70_1 | 1537 | 3091 |
| RFL 389 | Primepii.300k_Assembly_Contig_79_1 | 1538 | 3092 |
| RFL 390 | Wheat-Rye-6R.300k_Assembly_Contig_217_1 | 1539 | 3093 |
| RFL 390 | Anapurna.300k_Assembly_Contig_203_1 | 1540 | 3094 |
| RFL 391 | R197.300k_Assembly_Contig_159_2 | 1541 | 3095 |
| RFL 391 | Wheat-Rye-6R.300k_Assembly_Contig_146_2 | 1542 | 3096 |
| RFL 391 | Primepii.300k_Assembly_Contig_154_2 | 1543 | 3097 |
| RFL 391 | R0934F.300k_Assembly_Contig_144_2 | 1544 | 3098 |
| RFL 391 | Anapurna.300k_Assembly_Contig_152_2 | 1545 | 3099 |
| RFL 391 | R0932E.300k_Assembly_Contig_149_2 | 1546 | 3100 |
| RFL 392 | R0934F.300k_Assembly_Contig_118_2 | 1547 | 3101 |
| RFL 392 | Triticum-timopheevii.300k_Assembly_Contig_82_2 | 1548 | 3102 |
| RFL 393 | Primepii.300k_Assembly_Contig_115_3 | 1549 | 3103 |
| RFL 393 | Wheat-Rye-6R.300k_Assembly_Contig_108_3 | 1550 | 3104 |
| RFL 394 | R0934F.300k_Assembly_Contig_222_1 | 1551 | 3105 |

TABLE 7-continued

| RFL-Name | Name | SEQID-PRT1 | SEQID-DNA |
|---|---|---|---|
| RFL 395 | Primepii.300k_Assembly_Contig_159_1 | 1552 | 3106 |
| RFL 396 | Triticum-timopheevii.300k_Assembly_Contig_58_1 | 1553 | 3107 |
| RFL 397 | Triticum-timopheevii.300k_Assembly_Contig_46_2 | 1554 | 3133 |

Example 3: Mapping of the Genes Encoding Candidate Rf Proteins in the Chromosomal Intervals Associated with Fertility Restoration A. Fine-Mapping of the Genomic Region Containing Rf1 Genetic Determinants Three F2 mapping populations segregating for Rf1 (R197xKalahari, R204xAlixan and R0932ExAltigo) encompassing 210, 218 and 212 individuals respectively were phenotyped and genotyped with 18100 SNP markers using Limagrain's internal genotyping platform.

Fertility tests were conducted indoors under controlled growth conditions, either in growth chambers or in greenhouses, enabling normal fertility of the tested wheat plants. The fertility scores indicated have been calculated by dividing the total number of seeds threshed from a spike by the number of counted spikelets. The t-tests conducted were done by comparing the fertility scores of F1s made with a restorer and the fertility scores of a panel of elite inbred lines grown under the same conditions.

Rf1 was first mapped on the short arm of the chromosome 1A between 4 cM and 10.9 cM on Limagrain's internal consensus map and physically delimited by SNP markers cfn1087371 and cfn0530841. These two SNP markers delimit the largest possible interval defined by the three mapping populations.

Subsequently, joint analysis of the three mapping populations and phenotyping of the individual F2 recombinant plants on derived F3 families validated the QTL position and delimited the Rf1 interval between 7 CM and 8.9 cM on Limagrain's internal consensus map and physically delimited by SNP markers cfn1082074 and cfn0523990. We used the genomic resources of the IWGSC Whole genome assembly, 'IWGSC WGA' (available from June 2016 from the URGI IWGSC repository) to anchor the locus to the wheat genome reference physical map. The left border (cfn1082074) was anchored on the IWGSCWGAV02_1AS_scaffold44309 scaffold and the right border (cfn0523990) was anchored on the IWGSCWGAV02_1AS_scaffold47238 scaffold.

Next, the locus was fine-mapped by screening 2976 and 3072 F3 lines from R197xKalahari and R204xAlixan derived from F2 plants heterozygous at the locus. Phenotyping and analysis of recombinant plant progenies within the interval redefined a smaller mapping interval between 7.5 and 8.8 CM delimited by cfn0522096 and cfn0527067 SNP markers on the IWGSCWGAV02_1AS_scaffold44309 scaffold and the IWGSCWGAV02_1AS_scaffold47238 scaffold, respectively.

B. Fine-Mapping of the Genomic Region Containing Rf3 Genetic Determinants

Three F2 mapping populations (TJB155xAnapurna, 2852xAltamira, and AH46xR0946E) encompassing 217, 135, and 246 individuals respectively and a doubled-haploid (DH) population (H46xR934F) consisting of 140 individual plants segregating for Rf3 were phenotyped as described in example 1, and genotyped with 18100 SNP markers using Limagrain's internal genotyping platform. Rf3 was first mapped on the short arm of the chromosome 1B between 18.9 CM and 24.2 cM on Limagrain's internal consensus map and physically delimited by SNP markers cfn0554333 and cfn0560679. These two SNP markers delimit the largest possible interval defined by the four mapping populations.

Subsequently, joint analysis of the four mapping populations and validation of the phenotype of the individual F2/DH recombinant plants on derived F3 families validated the QTL, genetically delimited the locus between 22.2 cM and 22.7 cM on Limagrain's internal consensus map, and physically delimited the Rf3 interval between SNP markers cfn0436720 and cfn0238384. We used the genomic resources of the IWGSC Whole genome assembly, 'IWGSC WGA' (available from June 2016 from the URGI IWGSC repository) to anchor the locus to the physical map. The left border (cfn0436720) was anchored on the IWGSCWGAV02_1BS_scaffold35219 scaffold and the right border (cfn0238384) was anchored on the IWGSCWGAV02_1BS_scaffold5117 scaffold.

Next, the locus was fine-mapped by screening 2496 and 672 plants from TJB155xAnapurna and AH46xR0946E F2 plants heterozygous at the locus. Analysis of recombinant F3 plant progenies within the interval redefined a smaller mapping interval between 22.5 and 22.7 cM delimited by cfn1249269 and BS00090770 SNP markers on the IWGSCWGAV02_1BS_scaffold35219 scaffold and the IWGSCWGAV02_1BS_scaffold5117 scaffold, respectively.

C. Mapping of the Genomic Region Containing Rf7 Genetic Determinants

We crossed R197 and Primepii and then derived a population of 176 plants from individuals that were rf1 and rf3, i.e. not carrying the restorer alleles at the loci Rf1 and Rf3. The plants were genotyped with 18100 SNP markers using Limagrain's internal genotyping platform and phenotyped as described in example 1. We mapped the Rf7 locus on chromosome 7BL. Moreover, internal genotyping data showing a strong genetic divergence suggests the presence of an exotic chromosomal fragment which is stably transmitted through generations. We identified a large QTL ranging from 45 CM to 88 cM on chromosome 7B on Limagrain's internal consensus map with a peak on 46.7 CM (cfn0919993 with LOD score of 3.37E-40). Initial analysis of the recombinant plants suggests the Rf7 gene could be located between cfn3407185 and W90K_RAC875_c33564_120 markers delimiting a mapping interval of 0.3 cM between. 46.7 CM and 47 cM on Limagrain's internal consensus map.

Example 4: Identification of Candidate Orthologous RFL Groups

For each of the 282 RFL groups identified in example 2, the captured RFL ORFs (in the following referred to as protein sequences) were identified and the total number of RFL protein sequences is reported for each accession (Table 7, Table 8).

Only the following RFL clusters will be taken into consideration:
1. RFL cluster contains protein representatives for all seven accessions and the sequences show polymorphism and/or length differences.
2. RFL cluster contains representatives for only these accessions for which genetic characterization indicated that they may contain the same Rf gene or genes.

Tables 8A, 9A, 10 and 11 show the lists of the orthologous RFL groups correlating respectively with Rf1, Rf3, Rf7 and Rf-Rye-6R genes after the first screen. *T. timopheevii* is known to be fertile and, as a consequence, to restore T-CMS. This line is added here as it could contain any of the target Rf1, Rf3, Rf7 or Rf-rye genes.

Finally, only the orthologous RFL groups mapping in the chromosomal interval in wheat *Triticum aestivum* Chinese Spring reference genome are considered as candidates for further analyses. These orthologous RFL groups will be selected as "candidate Rf groups".

Mapping was achieved using the tool tblastn from the BLAST+ Suite (https://blast.ncbi.nlm.nih.gov/Blast.cgi?PAGE_TYPE=BlastDocs&DOC_TYPE=Download). Specific parameters (-evalue 1e-25-best_hit_score_edge 0.05-best_hit_overhang 0.25) were used in order to keep all best hits.

A. Results for Rf1 Accessions:

Table 8A shows the orthologous RFL groups comprising at least one sequence captured from an accession characterized as bearing the Rf1 gene (R197, R0932E and *T. timopheevii*). The mapping described in example 3 allows us to discard orthologous RFL groups mapped outside of the chromosomal interval genetically associated with Rf1 fertility on the short arm of chromosome 1A. In this way, four RFLs clusters (79, 104, 185 and 268) were identified as potentially corresponding to the Rf protein encoded by the Rf1 gene.

All protein sequences from group RFL185 contain ~500 amino acids and only 8.5 PPR motifs. Typically, full-length functional RFL proteins are expected to contain 15-20 PPR motifs. In addition, the last PPR motif of RFL185 is composed of only 15 amino acids. This indicates that RFL185 is truncated. RFL268 is also truncated (382 amino acids). Detailed sequence analysis has shown that RFL185 and RFL268 are remnants of the same gene that was split by a frameshift. Thus, both proteins are unlikely to be functional.

Hence RFL79 and RFL104 are considered as being the best candidate Rf groups for Rf1.

It can be noted from Table 8A that the only accession lacking Rf1 containing sequences in these candidate Rf groups is the accession R0934F.

TABLE 8B presents the proteins in the candidate Rf groups 79 and 104.

| RFL 79 | Cluster 79 | length | ORF name |
|---|---|---|---|
| 0 | 0 | 808aa | R197.300k__Assembly__Contig__120__1 |
| 1 | 1 | 808aa | R0932E.300k__Assembly__Contig__103__1 |
| 2 | 2 | 808aa | R0934F.300k__Assembly__Contig__80__1 |
| 3 | 3 | 808aa | Triticum-timopheevii.300k__Assembly__Contig__57__1 |

| RFL 104 | Cluster 104 | length | ORF name |
|---|---|---|---|
| 0 | 0 | 757aa | R197.300k__Assembly__Contig__72__1 |
| 1 | 1 | 757aa | R0932E.300k__Assembly__Contig__82__1 |
| 2 | 2 | 757aa | R0934F.300k__Assembly__Contig__69__1 |
| 3 | 3 | 757aa | Triticum timopheevii.300k__Assembly__Contig__35__1 |

The DNA sequences derived from the contigs identified in example 2 and encoding RFL proteins from candidate Rf groups 79 and 104 were aligned with BWA-MEM software (Li H. and Durbin R., 2010). It was observed that these sequences differ in the 5' UTR region in R0934F compared to R0932E and R197. One hypothesis is that the DNA sequences in R0934F were generated by a recombination event between the DNA sequences from candidate Rf groups 79 and 104. This recombined sequence may not be functional in R0934F as this line is only known to carry Rf3.

B. Results for Rf3 Accessions:

The same rationale as for the Rf1 accessions was applied to the accessions (Primepii and R0934F) characterized as carrying the Rf3 gene. Table 9A shows that orthologous RFL groups 67, 89, 140, 166 and 252 are candidate Rf groups for the Rf protein encoded by Rf3 as they contain proteins identified in Primepii and R0934, the two accessions characterized as carrying Rf3 restorer gene and are located in the mapped genetic interval on the short arm on chromosome 1B.

TABLE 8A

Selection of RFL based on accession CMS information for Rf1.

| CMS genotype RFLGene | MAINTAINER ANAPURNA | Rf3 PRIMEPII | Rf1 + Rf7 R197 | Rf1 R0932E | Rf3 R0934F | Restorer from Rye introgression Wheat-Rye-6R | Restorer *Triticum timopheevii* | Mapping Positionned in Rf1 mapping interval |
|---|---|---|---|---|---|---|---|---|
| RFL1 | 0 | 0 | 1 | 1 | 0 | 0 | 0 | NO |
| RFL56 | 0 | 0 | 1 | 1 | 0 | 0 | 1 | NO |
| RFL59 | 0 | 0 | 1 | 2 | 0 | 0 | 1 | NO |
| RFL73 | 0 | 0 | 1 | 1 | 0 | 0 | 1 | NO |
| RFL74 | 0 | 0 | 3 | 4 | 3 | 0 | 0 | NO |
| RFL79 | 0 | 0 | 1 | 1 | 1 | 0 | 1 | YES |
| RFL93 | 0 | 0 | 1 | 1 | 0 | 0 | 0 | NO |
| RFL104 | 0 | 0 | 1 | 1 | 1 | 0 | 1 | YES |
| RFL129 | 0 | 0 | 1 | 1 | 1 | 0 | 0 | NO |
| RFL185 | 0 | 0 | 1 | 1 | 1 | 0 | 1 | YES |
| RFL268 | 0 | 0 | 1 | 1 | 1 | 0 | 1 | YES |

TABLE 9A selection of RFL clusters based on germplasm CMS information for Rf3

| CMS genotype RFLGene | MAINTAINER ANAPURNA | Rf3 PRIMEPII | Rf1 + Rf7 R197 | Rf1 R0932E | Rf3 R0934F | Restorer from Rye introgression Wheat-Rye-6R | Restorer Triticum timopheevii | Mapping Positionned in Rf3 mapping interval |
|---|---|---|---|---|---|---|---|---|
| RFL22  | 0 | 1 | 0 | 0 | 1 | 0 | 0 | NO |
| RFL67  | 0 | 4 | 0 | 0 | 3 | 0 | 0 | YES* |
| RFL89  | 0 | 2 | 0 | 0 | 1 | 0 | 0 | YES |
| RFL140 | 0 | 1 | 0 | 0 | 1 | 0 | 0 | YES |
| RFL142 | 0 | 1 | 0 | 0 | 1 | 0 | 0 | NO |
| RFL164 | 0 | 1 | 0 | 0 | 1 | 0 | 0 | NO |
| RFL166 | 0 | 1 | 0 | 0 | 1 | 0 | 0 | YES |
| RFL227 | 0 | 1 | 0 | 0 | 1 | 0 | 0 | NO |
| RFL252 | 0 | 1 | 0 | 0 | 1 | 0 | 0 | YES |

In order to achieve an exhaustive analysis for selection of Rf3 candidates, all 282 RFL clusters were carefully analyzed with regard to number of RFLs, their length and their origin in relation to Rf3 genotype information. RFL clusters composed of RFL sequences from multiple accessions were screened for full-length protein sequences originating only from Primepii and R0934F genotypes and partial/shorter sequences from the non-Rf3-carrying genotypes. This analysis allowed the identification of four additional Rf3-candidate RFL clusters: RFL28, RFL29, RFL60 and RFL170.

TABLE 9B details of the proteins present in RFL cluster 28, 29, 60 and 170 including protein length (aa = amino acids) and name.

| RFL 28 | Cluster 28 | Rf3 | |
|---|---|---|---|
| 0 | 0 | 323aa | Anapurna.300k_Assembly_Contig_2_3 |
| 1 | 1 | 479aa | Anapurna.300k_Assembly_Contig_2_2 |
| 2 | 2 | 857aa | Primepii.300k_Assembly_Contig_13_1 |
| 3 | 3 | 323aa | R197.300k_Assembly_Contig_10_3 |
| 4 | 4 | 479aa | R197.300k_Assembly_Contig_10_2 |
| 5 | 5 | 479aa | R0932E.300k_Assembly_Contig_23_2 |
| 6 | 6 | 323aa | R0932E.300k_Assembly_Contig_23_3 |
| 7 | 7 | 857aa | R0934F.300k_Assembly_Contig_17_1 |
| 8 | 8 | 323aa | Wheat-Rye-6R.300k_Assembly_Contig_7_3 |
| 9 | 9 | 479aa | Wheat-Rye-6R.300k_Assembly_Contig_7_2 |

| RFL 29 | Cluster 29 | Rf3 | |
|---|---|---|---|
| 0 | 0 | 828aa | Primepii.300k_Assembly_Contig_67_1 |
| 1 | 1 | 828aa | R0934F.300k_Assembly_Contig_78_1 |
| 3 | 2 | 536aa | Wheat-Rye-6R.300k_Assembly_Contig_77_2 |
| 4 | 3 | 295aa | Wheat-Rye-6R.300k_Assembly_Contig_77_1 |

| RFL 60 | Cluster 60 | Rf3 | |
|---|---|---|---|
| 0 | 0 | 828aa | Primepii.300k_Assembly_Contig_94_1 |
| 1 | 1 | 287aa | R197.300k_Assembly_Contig_95_1 |
| 2 | 2 | 828aa | R0934F.300k_Assembly_Contig_73_2 |
| 4 | 3 | 809aa | Wheat-Rye-6R.300k_Assembly_Contig_48_2 |

| RFL 170 | Cluster 170 | Rf3 | |
|---|---|---|---|
| 0 | 0 | 219aa | Anapurna.300k_Assembly_Contig_174_3 |
| 1 | 1 | 560aa | Primepii.300k_Assembly_Contig_60_2 |
| 2 | 2 | 369aa | R197.300k_Assembly_Contig_94_2 |

TABLE 9B-continued details of the proteins present in RFL cluster 28, 29, 60 and 170 including protein length (aa = amino acids) and name.

| 3 | 3 | 560aa | R0934F.300k_Assembly_Contig_67_2 |
| 4 | 4 | 369aa | Wheat-Rye-6R.300k_Assembly_Contig_113_2 |

Table 9B shows that:

In candidate group RFL 28, the sequences from Rf3 genotypes (Primepii and R0934F) are 857 amino acids long whereas sequences from all other germplasms (non-Rf3) are truncated (sizes ranging from 323-479 amino acids) and thus are most probably nonfunctional.

In candidate group RFL 29, the sequences from Rf3 accessions (Primepii and R0934F) are 828 amino acids long whereas sequences from all other (non-Rf3) germplasms are truncated and thus most probably nonfunctional.

In candidate group RFL 60, the sequences in non-Rf3 genotypes (R197 and R0932E) are either absent (R0932E) or deemed nonfunctional due to their amino acid length (287 amino acids). The sequences from Rf3 genotypes Primepii and R0934F based on their sequence length appear to be full length and functional. In addition, our mapping analysis positioned RFL60 cluster within the Rf3 interval.

In cluster RFL 170, the sequences from Rf3 genotypes (Primepii and R0934F) are significantly larger (560 amino acids) than sequences from non Rf3 genotypes that appear truncated (below 370 amino acids) and are considered as being nonfunctional. Our detailed sequence analysis has shown that RFL170 is actually a second ORF, in addition to RFL 288, encoded by the same contig. Both ORFs originate from the same RFL gene in which contiguity was disrupted by a frameshift.

C. Rf7 and Rf-Rye Accessions:

The same rationale as for the analysis of Rf1 and Rf3 carrying accessions was applied to the accessions carrying the Rf7 restorer gene (R197 and T. timopheevii). The Rf7 gene was mapped on chromosome 7BL.

Table 10 shows that RFL 80, 128 and 191 are candidate Rf groups for the Rf protein encoded by the Rf7 gene as the proteins assigned to those clusters were found only in either R197 or T. timopheevii.

In regard to a restorer gene that originates from the introgression of rye chromosome 6R into wheat genome, clusters composed of single proteins originating from the Wheat-Rye-6R restorer line are considered as good candidates for a Rye-6R-specific restorer gene. Those criteria are true for the RFL 46, 87 and 208 orthologous groups listed in Table 6. Due to their high sequence divergence compared to *Triticum* sequences these genes are great candidates for restorer genes originating from rye.

cloning purpose as depicted respectively in SEQ ID N°3117 to 3120. These sequences were cloned via a Golden Gate reaction into the destination binary plasmid pBIOS10746.

TABLE 10 selection of RFL based on germplasm CMS information for Rf7

| CMS genotype RFLGene | MAINTAINER ANAPURNA | Rf3 PRIMEPII | Rf1 + Rf7 R197 | Rf1 R0932E | Rf3 R0934F | Restorer from Rye introgression Wheat-Rye-6R | Restorer *Triticum timopheevii* | Mapping Positionned in Rf7 mapping interval |
|---|---|---|---|---|---|---|---|---|
| RFL49 | 0 | 0 | 2 | 0 | 0 | 0 | 2 | NO |
| RFL63 | 0 | 0 | 2 | 0 | 0 | 0 | 1 | NO |
| RFL80 | 0 | 0 | 1 | 0 | 0 | 0 | 0 | Not mapped |
| RFL85 | 0 | 0 | 2 | 0 | 0 | 0 | 1 | NO |
| RFL125 | 0 | 0 | 1 | 0 | 0 | 0 | 2 | NO |
| RFL128 | 0 | 0 | 1 | 0 | 0 | 0 | 0 | Not mapped |
| RFL174 | 0 | 0 | 1 | 0 | 0 | 0 | 2 | NO |
| RFL191 | 0 | 0 | 1 | 0 | 0 | 0 | 0 | Not mapped |

TABLE 11 selection of RFL based on germplasm CMS information for Rf-rye

| CMS genotype RFLGene | MAINTAINER ANAPURNA | Rf3 PRIMEPII | Rf1 + Rf7 R197 | Rf1 R0932E | Rf3 R0934F | Restorer from Rye introgression Wheat-Rye-6R | Restorer *Triticum timopheevii* |
|---|---|---|---|---|---|---|---|
| RFL46 | 0 | 0 | 0 | 0 | 0 | 1 | 0 |
| RFL87 | 0 | 0 | 0 | 0 | 0 | 1 | 0 |
| RFL208 | 0 | 0 | 0 | 0 | 0 | 1 | 0 |

Example 5: Cloning of Candidate Genes for Fertility Restoration of *T. timopheevii* CMS The nucleic acid sequence encoding any of the RFL proteins from a candidate Rf group could be used for cloning and transformation. However, in the present experiment for cloning and transformation purposes, a DNA sequence encoding the longest RFL protein which was characterized as having a start codon, mitochondrial targeting sequence and number of PPR motifs between 15 and 20 was preferentially used. If at least two longest RFL proteins happen to have the same length, the nucleic acid encoding such RFL protein, and presenting the longest 5'-UTR sequence will be preferentially chosen to perform the cloning and transformation steps.

Wheat-Rye-6R RFL46 sequence derived from Wheat-Rye-6R.300k_Assembly_Contig_35_1 was optimized to provide SEQ ID N°3115. This sequence was cloned via a Golden Gate reaction into the destination binary plasmid pBIOS10746, between the constitutive *Zea mays* ubiquitin promoter (proZmUbi depicted in SEQ ID N° 3134) with the *Zea mays* ubiquitin intron (intZmUbi, depicted in SEQ ID N° 3109, Christensen et al 1992) and a 3' termination sequence of the gene encoding a sorghum heat shock protein (accession number: Sb03g006880); The termination sequence, named terSbHSP, is depicted in SEQ ID N° 3110. The sequence of the recombinant construct is depicted in SEQ ID N°3125.

Similarly as above, TaRFL104 sequence (derived from R0932E.300k_Assembly_Contig_82_1), TaRFL67 sequence (derived from Primepii.300k_Assembly_Contig_2_1), TaRFL79 sequence (derived from R197.300k_Assembly_Contig_120_1) and TaRFL89 sequence (derived from R0934F.300k_Assembly_Contig_99_1) were adapted for The sequences of the recombinant constructs are respectively depicted in SEQ ID N°3131, 3128, 3129 and 3130.

TaRFL104 sequence (depicted in SEQ ID N°3117) was cloned via restriction enzyme reaction, between the native *Triticum aestivum* promoter (proTaRFL104, SEQ ID N° 3113) and the 3' termination sequence of *Triticum aestivum* RFL104 encoding gene (terTaRFL104, depicted in SEQ ID N° 3112), into the destination binary plasmid pBIOS10747. The sequence of the recombinant construct is depicted in SEQ ID N°3126.

TaRFL79 sequence (depicted in SEQ ID N°3119) was cloned via restriction enzyme reaction, between the native *Triticum aestivum* promoter (proTaRFL79, SEQ ID N°3123) and the 3' termination sequence of *T. aestivum* RFL79 encoding gene (terTaRFL79, depicted in SEQ ID N° 3124), into the destination binary plasmid pBIOS10747. The sequence of the recombinant construct is depicted in SEQ ID N°3122.

Wheat-Rye RFL46 sequence was also cloned via restriction enzyme reaction, between the native *Triticum aestivum* promoter (proTaRFL46, SEQ ID N° 3114) and the 3' termination sequence of *Triticum aestivum* RFL46 encoding gene (terTaRFL46, depicted in SEQ ID N° 3111), into the destination binary plasmid pBIOS10747. For this construct, Wheat-Rye RFL46 sequence is derived from Wheat-Rye-6R.300k_Assembly_Contig_35_1 coding sequence and modified for cloning purpose without any optimization steps. The coding sequence is depicted in SEQ ID N°3116. The sequence of the recombinant construct is depicted in SEQ ID N°3127.

The binary destination vectors pBIOS10746 and pBIOS10747 are a derivative of the binary vector pMRT (WO2001018192A3).

All the binary plasmids described above were transformed into *Agrobacterium* EHA105.

Example 6: Transformation & Fertility Restoration Phenotyping Assays

In order to screen for candidate genes involved in fertility restoration, the BGA_Fielder_CMS wheat cultivar harboring both cytoplasmic male sterility and strong transformability and regeneration potential was developed. BGA_Fielder_CMS wheat cultivars were transformed with Agrobacterium strains obtained in example 5 essentially as described by WO 2000/063398. Wheat transgenic events were generated for each construct described above.

For construct comprising RFL46, transformation was also performed with the cultivar Fielder.

All wheat transgenic plants generated in example 6 and control fertile plants were grown in a glasshouse under standard wheat growth conditions (16 h of light period at 20° C. and 8 h of dark period at 15° C. with constant 60% humidity) until control grains of the wild type Fielder cultivar reached maturity stage.

Fertility of the transgenic plants was evaluated by counting the number of seeds and empty glumes per spikes on each plant and comparing with the wild type Fielder and BGA_Fielder_CMS control plants. Plants are also evaluated by observing anther extrusion.

16 transformed CMS-Fielder plants overexpressing the RFL79 sequence recited in SEQ ID N°361 (as listed in table 7) under the ZmUbi promoter derived from 11 independent transformation events were analyzed.

All the plants present restoration of male fertility while 100% of untransformed CMS-Fielder plants grown in parallel are fully sterile with no anther extrusion and no seed produced, and 100% of WT-Fielder plants are fertile.

These results confirm that RFL79 can restore fertility of a CMS-T plant and that genetic transformation of CMS-Fielder is an efficient system to test the function of restorer-of-fertility genes.

Example 7: Cloning of Rf Gene Promoter, Transformation and GUS Assays

The E. coli beta-glucuronidase (EcGUS) sequence was optimized (as depicted in SEQ ID N°3121) and cloned via restriction enzyme reaction, between the native Triticum aestivum promoter (proTaRFL46, SEQ ID N° 3114) and the 3' termination sequence of T. aestivum gene encoding RFL46 (terTaRFL46, depicted in SEQ ID N° 3111), into the destination binary plasmid pBIOS10743 forming pBIOS11468.

Fielder wheat cultivars were transformed with these Agrobacterium strains essentially as described by WO 2000/063398. Wheat transgenic events were generated for each construct described above.

After booting stage until anthesis, heads and floral organs were dissected and incubated in X-Gluc solution (Jefferson, 1987) at 37° C. for 16 hours, to assess GUS expression.

Example 8: Identification of Full Length RFL PPR Genes Potentially Involved in Rf4 Fertility Restoration A second capture was achieved using a set of different accessions compared to the capture performed in example 2. The following accessions were used:

Two Maintainer lines (Anapurna, Fielder)
The T. timopheevii accession as described in example 2
Four accessions identified as restorer lines of T. timopheevii-type CMS and characterized by the presence of the Rf4 restorer locus: L13, R113, 17F3R-0377 and GSTR435.
Rf1, Rf3 and Rf7 restorer accessions which are characterized by the absence of the Rf4 restorer locus: R197, R0934F.

GSTR435 is derived from an introgression of Aegilops speltoïdes into Triticum aestivum and at is available USDA (https://npgsweb.ars-grin.gov/gringlobal/search.aspx). The three other accessions, R113 (available via Australian Grains Genebank: 90819), L13 (available via Australian Grains Genebank: 90821) and 17F3R-0377 (derived from R113) are all derived from Triticum timopheevi introgressions into Triticum aestivum.

The bait design and hybridization with DNA fragments from the accessions were performed as in example 2. Then, a subset of 100K read pairs from each accession were mapped to the RFL groups identified in table 7 using Novoalign (version 3.04.06, http://www.novocraft.com/products/novoalign/) with settings allowing multiple hits with approximately 97% of identity (options: -r all -t 240). The average coverage per RFL was calculated using Bedtools utilities (version 2.26.0, then http://github.com/arq5x/bedtools2) coverageBed (option: -d) and groupBy (options: -o mean).

The relative coverage of all RFLs with the reads from each accession was assessed. A first ranking of the RFLs according to their coverage with reads from accessions derived from T. timopheevii was assessed. Only RFL groups showing no coverage (value from 0 to 10) with reads from "non-Rf" (maintainer) or non-Rf4 accessions but showing significant coverage (value>30) with reads from Rf4 accessions were considered. FIG. 3 shows the list of these RFL groups potentially corresponding to the Rf4 gene.

The coverage with accession GSTR435 was also assessed. FIG. 3 shows that only RFL120 shows significant coverage in accession GSTR435, although lower than for the other accessions. This could be explained by a greater phylogenetic distance between T. aestivum and Aegilops speltoïdes than between T. aestivum and T. timopheevii.

In order to investigate further the sequences related to the RFL120 group, the reads mapping to RFL120 for each Rf4 accession were then assembled in two steps. The first step consisted of merging overlapping read pairs with the utility bbmerge.sh from the BBMAP package (version 36.59 https://sourceforge.net/projects/bbmap/) and assembling them with the utility tadwrapper.sh from the same package (options: k=150,180,210,240,270,300,330,360,390,420,450 bisect=t). The contigs from the first step were deduplicated with the tool dedupe.sh also from the same package and given to another assembler, SPADES (version 3.10.1 http://bioinf.spbau.ru/spades), as "trusted contigs" along with all read pairs from the same accession (options: --cov-cutoff 5-careful) to generate the final assembly of the accession. Then for each accession the protein sequence RFL120 (SEQ ID N° 477 as listed in table 7) best hit was searched using the tblastn utility from the BLAST+ package (version 2.2.30 https://blast.ncbi.nlm.nih.gov/Blast.cgi?PAGE_TYPE=BlastDocs&DOC_TYPE=Download) using default settings.

The following sequences were finally identified to be included in the RFL120 group:
RFL120-R113 which is depicted in SEQ ID N°3138 and is encoded by SEQ ID N°3142, RFL120-L13 which is depicted in SEQ ID N°3137 and is encoded by SEQ ID N°3141, RFL120-17F3R-0377 is depicted in SEQ ID N°3135 and is encoded by SEQ ID N°3139 and finally RFL120-GSTR 435 (called here RFL120-spelt) is depicted in SEQ ID N°3136 and is encoded by SEQ ID N°3140.

Alignment between the above amino acid or nucleotide sequences with the corresponding sequences from RFL120, called here "RFL120_timo", and recited in SEQ ID N°477 and SEQ ID N°2031 (see table 7) shows that RFL120-17F3R-0377 is truncated. Regarding RFL120-R113 and RFL120-L13, the nucleotide sequences are both identical to RFL120-timo except that they are respectively 357 and 349 nucleotides longer on the 5'UTR region.

FIGS. 4a and 4b shows respectively the alignment between nucleotide and amino acid sequences of RFL120-spelt with RFL120-timo. This shows that RFL120-timo nucleotide sequence is 95% identical to the "RFL120_spelt" one which explains the low coverage previously observed with GSTR435 in FIG. 3.

In conclusion, the results confirm that the RFL120 group is the strongest candidate for Rf4.

Example 9: Cloning, Transformation and Fertility Restoration Assays

Following the same methods as described in Examples 5 and 6, the nucleotide sequences of RFL120-timo, RFL120-spelt, RFL120-R113 and RFLK120-L13 are, when appropriate, optimized for ensuring proper expression in wheat and adapted for cloning purposes.

These sequences are cloned via a Golden Gate reaction into the destination binary plasmid pBIOS10746, between the constitutive *Zea mays* ubiquitin promoter (proZmUbi depicted in SEQ ID N° 3134) with the *Zea mays* ubiquitin intron (intZmUbi, depicted in SEQ ID N° 3109, Christensen et al 1992) and a 3' termination sequence of the gene encoding a sorghum heat shock protein (accession number: Sb03g006880); The termination sequence, named terSbHSP, is depicted in SEQ ID N° 3110.

Transformation and fertility assays are performed as in Example 6.

Example 10: Evaluation of the CMS *T. timopheevii* Rf3 Restorer Lines Fertility

Eleven wheat elite lines classified as carrying Rf3 restorer gene known to be involved in restoration of the T-type cytoplasmic male sterility in *Triticum timopheevii* (T-CMS) were assessed for their capacity to restore the T-CMS cytoplasm and characterized for their fertility genotype. Hybrids resulting from crosses between a sterile CMS wheat line, used as a female parent, and a given wheat restorer line, used as a pollen donor, were studied regarding their ability to produce grain. The elite lines included both commercially available lines such as Altigo, Aristote, Cellule, Altamira, Rubisko, Primepii or Premio as well as Limagrain proprietary lines (Table 12). In addition, Chinese Springlines were included in the study (Table 12).

Fertility tests have been conducted indoors, either in growth chamber or in greenhouse, under controlled growth conditions enabling a normal expression of the fertility phenotype of the tested wheat plants. The plants were grown under 16 hours light period and temperature between 2° and 25° C. and 8 hours dark period at a temperature between 15° C. and 20° C., with humidity between 50 and 70%. The observed restoration of pollen fertility may be partial or complete.

The fertility score of F1 wheat plants carrying T-CMS cytoplasm may be calculated by dividing the total number of seeds threshed from a spike by the number of counted spikelets and may be compared with the fertility scores of a panel of control fertile plants which in this study consists of elite inbred lines bearing a normal wheat cytoplasm, grown in the same area and under the same agro-environmental conditions. It is preferred that such panel of lines comprises a set of at least 5 elite inbred lines. Besides, it is preferred that at least 10 spikes from different F1 individual plant will be assessed for a given experiment.

Fertility score i higher than zero (>0) indicates that the plant has acquired partial or full fertility restoration. For each fertility score, a statistical test is achieved to obtain a p-value. Examples of statistical tests are the Anova or mean comparison tests. A p-value below a 5% threshold will indicate that the two distributions are statistically different. Therefore, a significantly lower fertility score of the tested wheat plant as compared to the fertility score of the fertile control plant is indicative that the F1 plant has not acquired full restoration fertility (i.e. partial restoration). A significantly similar or higher fertility score is indicative that the F1 plant has acquired full restoration of fertility. The fertility scores indicated were calculated by dividing the total number of seeds threshed from a spike by the number of counted spikelets.

The t-tests were conducted by comparing the fertility scores of F1 plants carrying Rf3 restorer gene and the fertility scores of a panel of elite inbred lines grown under the same conditions (633 spikes from 37 winter and spring elite lines; $\mu=2.36$, $\alpha=0.59$).

The results presented in Table 12 show that there are two types of partial Rf3 restorer of fertility in the CMS hybrids. One that can be referred to as "Rf3" and which fertility scores are comprised between 1 and 1.8, and a second type referred to as "Rf3 weak" which fertility scores are less than 1. For example, the CMS-hybrids made with Primepii produced an average fertility score of 1.7 grains/spikelet over 10 individual F1 spikes ("Rf3" phenotype) while hybrids made with Altigo produced an average fertility score of 0.7 grains/spikelet over 47 individual F1 spikes ("Rf3 weak" phenotype) (Table 12). Different Chinese Spring lines were shown by genetic mapping and marker assisted selection to harbor an Rf3 restorer locus (data not shown). CMS-hybrids made with Chinese Spring lines were evaluated for fertility score. They show a mean estimated fertility score of 0.6 grains/spikelet and a "Rf3 weak" phenotype.

TABLE 12

Wheat elite lines used in the study and the fertility scores of CMS-hybrids generated with their pollen.

| Elite variety | Genotype | Phenotype | Number of analysed spikes | Fertility score | STD |
|---|---|---|---|---|---|
| CHINESE SPRING | RFL29b | Rf3 weak | 20 | 0.6 | 0.7 |
| ALTIGO | RFL29b | Rf3 weak | 47 | 0.7 | 0.5 |
| ARISTOTE | RFL29b | Rf3 weak | 43 | 0.8 | 0.8 |
| CELLULE | RFL29a | Rf3 | 10 | 1.2 | 1.0 |
| ALTAMIRA | RFL29a | Rf3 | 20 | 1.5 | 1.1 |
| PREMIO | RFL29a | Rf3 | 12 | 1.2 | 1.0 |
| PRIMEPII | RFL29a | Rf3 | 10 | 1.7 | 0.8 |
| R0946E | RFL29a | Rf3 | 35 | 1.8 | 0.6 |
| RUBISKO | RFL29a | Rf3 | 7 | 1.2 | 0.6 |

TABLE 12-continued

Wheat elite lines used in the study and the fertility
scores of CMS-hybrids generated with their pollen.

| Elite variety | Genotype | Phenotype | Number of analysed spikes | Fertility score | STD |
|---|---|---|---|---|---|
| TJB155 | RFL29a | Rf3 | 27 | 1.7 | 0.7 |
| ATOMO | RFL29c | Maintainer | 22 | 0.0 | 0.0 |
| CONTROL ELITES | | | 633 | 2.4 | 0.6 |

*NA: Not available, STD: Standard Deviation

Example 11: Comparison of Genotypes Between the Analyzed Rf3 Restorer Lines

The RFL gene capture was achieved with accessions listed in Table 12 as described in Example 2. For each RFL identified in Example 4B, the corresponding protein sequences from each accession were aligned for comparison.

The results show that for RFL29, RFL164 and RFL166, strong association between the phenotype and the genotype exist. For RFL29, three different alleles referred to as "a", "b" and "c" were identified while two different alleles "a" and "b" are identified either for RFL164 or RFL166. All accessions with an "Rf3" phenotype carry RFL29a, RFL164a and RFL 166a alleles while all the "Rf3 weak" accessions carry RFL29b, RFL166b and RFL164b alleles in their genotype For RFL29, the maintainer line Atomo is characterized by the presence of two truncated ORFs, probably due to a frameshift mutation, RFL29c_1 and RFL29c_2, encoding proteins consisting of 258 and 535 amino acids, respectively. This genotype form is only present in maintainer lines (data not shown).

FIG. 5A shows the protein sequence alignment of RFL29a, RFL29b, RFL29c_1 and RFL29c_2. FIGS. 5B and 5C, respectively, show the protein sequence alignments of RFL164a and RFL164b (depicted in SEQ ID N°3144), and RFL166a and RFL166b (depicted in SEQ ID N°3145).

Example 12: Cloning, Transformation and Fertility Restoration Assays

Following the same methods as described in Examples 5 and 6, the nucleotide sequences of RFL29a (depicted in SEQ ID N° 3146 or SEQ ID N°1712 and encoding a sequence identical to SEQ ID N°158), RFL29b (depicted in SEQ ID N° 3149 and encoding a sequence identical to SEQ ID N°3143), RFL164a (depicted in SEQ ID N° 3147 or SEQ ID NO° 2230 and encoding a sequence identical to SEQ ID N°676), and RFL166a (depicted in SEQ ID N° 3148 or SEQ ID NO:2238 and encoding a sequence identical to SEQ ID N°684), were cloned via a Golden Gate reaction into destination binary plasmid pBIOS10746, between the constitutive Zea mays ubiquitin promoter (proZmUbi depicted in SEQ ID N° 3134) with the Zea mays ubiquitin intron (intZmUbi, depicted in SEQ ID N° 3109, Christensen et al 1992) and a 3' termination sequence of the gene encoding a sorghum heat shock protein (accession number: Sb03g006880 terSbHSP depicted in SEQ ID N° 3110). The sequences of each of the recombinant constructs are respectively depicted in SEQ ID N°3150, SEQ ID N°3151, 3152 and 3153.

Similarly, the RFL29a and RFL29b sequences were cloned downstream of their endogenous promoter pRFL29a (depicted in SEQ ID N°3154) and pRFL29b (depicted in SEQ ID N°3155) and the terminator sequence terSbHSP. The sequences of each of the recombinant construct are respectively depicted in SEQ ID N°3156 and SEQ ID N°3157.

Finally, two other cassettes were made identically as described previously with the only exception that the corresponding endogenous terminator sequences terRFL29a (depicted in SEQ ID N°3160) and terRFL29b (depicted in SEQ ID N°3161) are used. The corresponding expression cassettes are respectively depicted in SEQ ID N°3158 and SEQ ID N°3159.Transformation and fertility assays are performed as in Example 6.

Example 13: Comparison of the 5'UTR Sequence of the RFL29a and RFL29b Encoding Gene In order to analyze whether the variation of the level of fertility could be explained by a variation in the gene expression level, the 5'UTR sequence of RFL29a gene was isolated from BACs generated from TJB155 line (Table 12) classified as "Rf3" and the 5'UTR sequence of RFL29b was identified from the Chinese Spring classified as "Rf3weak" line (IWGSC RefSeq v1.0 assembly).

The alignment of the 5'UTR regions identified in the RFL29a and RFL29b genes is shown in FIG. 6.

Sequence comparison shows that the 5'UTR sequence of the RFL29a gene comprises a deletion of the 163 bp-long region identified in the 5'UTR of RFL29b corresponding sequence (SEQ ID NO: 3174). Part of this region has been identified in the patent application WO2018015403 as being putatively involved in miRNA-mediated repression of the expression of the PPR gene identified downstream.

Sequence comparison between the different accessions listed in Table 12 shows that all "Rf3weak" accessions harbor the 163 bp and all the "Rf3" accessions harbor the 163 bp deletion.

Because of the 163 bp deletion in the 5'UTR sequence of RFL29a gene, it is expected that the 163 bp region impairs the expression of RFL29b gene such that the fertility level is weak in lines harboring the RFL29b allele compared to lines harboring the RFL29a allele.

Example 14: Cloning, Transformation and Fertility Assays with a Deleted TaRFL29b Promoter Following the same methods as described in Example 5, the nucleotide sequence of RFL29b was expressed under the modified promoter pRFL29bdel (depicted in SEQ ID N°3162) which is bearing a deletion of the 163 bp region, from the nucleotide 1876 to nucleotide 2038 of the RFL29b promoter sequence depicted in SEQ ID N°3155. The termination sequence, terSbHSP, depicted in SEQ ID N°3110 is used. The recombinant construct is depicted in SEQ ID N°3163.

Transformation of CMS*Fielder wheat line (which is either not "Rf3" or "Rf3 weak") is performed as in Example 6 except that the following controls are added: all of the "Rf3" phenotype lines as listed in Table 12, all of the "Rf3 weak" lines as listed in Table 12 and finally the transformed lines with the cassette harboring the pTaRFL29b promoter upstream to RFL29b as described in example 12.

Example 15: Modification of the Endogenous Promoter of RFL29b by CRISPR Technology to Revert "Rf3Weak" Lines to "Rf3" Lines In order to increase the expression of RL29b, different deletions of the 163 bp are performed in the promoter of RFL29b using endonuclease for site-directed mutagenesis.

Table 13 provides the different endonucleases with the associated PAM motif and the corresponding target sequences.

FIG. 7 shows the position of the different target sequences around and within the 163 bp region identified for different endonucleases. The designed guide sequences that can be used in combination to perform a deletion in the 163 bp region are listed in Table 13.

TABLE 13

| Endonucleases | Target_ID | Target name | guide sequence |
|---|---|---|---|
| LbCPF1 | 23 | LbCpf1-100-Target-23 | TAATTTCTACTAAGTGTAGATCGAGCGGAGGGAGTACTAGATAA(SEQ ID NO: 3175) |
| LbCPF1 | 42 | LbCpf1-100-Target-42 | TAATTTCTACTAAGTGTAGATGGAACGGAGGGAGTATTATCTAG(SEQ ID NO: 3176) |
| LbCPF1 | 67 | LbCpf1-100-Target-67 | TAATTTCTACTAAGTGTAGATAGATAGCTAGAAAGACAATTATT(SEQ ID NO: 3177) |
| LbCPF1 | 71 | LbCpf1-100-Target-71 | TAATTTCTACTAAGTGTAGATTTTGAGATAGCTAGAAAGACAAT(SEQ ID NO: 3178) |
| SpCAS9 | 14 | SpCas9-100-Target-14 | TGACAAGTATTTCCGAGCGGGTTTTAGAGCTAGAAATAGCAAGTTAAAATAAGGCTAGTCCGTTATCAACTTGAAAAAGTGGCACCGAGTCGGTGCTTTT(SEQ ID NO: 3179) |
| SpCAS9 | 54 | SpCas9-100-Target-54 | GACAATTATTTAGGAACGGAGTTTTAGAGCTAGAAATAGCAAGTTAAAATAAGGCTAGTCCGTTATCAACTTGAAAAAGTGGCACCGAGTCGGTGCTTTT(SEQ ID NO: 3180) |
| SpCAS9 | 55 | SpCas9-100-Target-55 | AGACAATTATTTAGGAACGGGTTTTAGAGCTAGAAATAGCAAGTTAAAATAAGGCTAGTCCGTTATCAACTTGAAAAAGTGGCACCGAGTCGGTGCTTTT(SEQ ID NO: 3181) |
| SpCAS9 | 58 | SpCas9-100-Target-58 | GAAAGACAATTATTTAGGAAGTTTTAGAGCTAGAAATAGCAAGTTAAAATAAGGCTAGTCCGTTATCAACTTGAAAAAGTGGCACCGAGTCGGTGCTTTT(SEQ ID NO: 3182) |
| SpCAS9 | 63 | SpCas9-100-Target-63 | AGCTAGAAAGACAATTATTTGTTTTAGAGCTAGAAATAGCAAGTTAAAATAAGGCTAGTCCGTTATCAACTTGAAAAAGTGGCACCGAGTCGGTGCTTTT(SEQ ID NO: 3183) |
| SpCAS9 | 155 | SpCas9-100-Target-155 | TTTCAACAAATGACTACATAGTTTTAGAGCTAGAAATAGCAAGTTAAAATAAGGCTAGTCCGTTATCAACTTGAAAAAGTGGCACCGAGTCGGTGCTTTT(SEQ ID NO: 3184) |
| SpCAS9 | 179 | SpCas9-100-Target-179 | CTCTAGAGAGACAATTATTTGTTTTAGAGCTAGAAATAGCAAGTTAAAATAAGGCTAGTCCGTTATCAACTTGAAAAAGTGGCACCGAGTCGGTGCTTTT(SEQ ID NO: 3185) |
| SpCAS9 | 184 | SpCas9-100-Target-184 | GAGAGACAATTATTTAGGAAGTTTTAGAGCTAGAAATAGCAAGTTAAAATAAGGCTAGTCCGTTATCAACTTGAAAAAGTGGCACCGAGTCGGTGCTTTT(SEQ ID NO: 3186) |

The nucleotide sequence encoding for LbCpf1 endonuclease is optimized (as depicted in SEQ ID N°3164) and cloned via a Golden Gate reaction into the destination binary plasmid pBIOS10746, between the constitutive Zea mays ubiquitin promoter (proZmUbi depicted in SEQ ID N° 3134) with the Zea mays ubiquitin intron (intZmUbi, depicted in SEQ ID N° 3109, Christensen et al 1992) and in the 3' region, the mouse nuclear import NLS sequence (as depicted in SEQ ID N° 3172) and the 3' termination sequence terZmHSP depicted in SEQ ID N° 3170.

The nucleotide sequence encoding for SpCas9 endonuclease is optimized (as depicted in SEQ ID N° 3165) and cloned via a Golden Gate reaction into the destination binary plasmid pBIOS10746, downstream to the constitutive Zea mays ubiquitin promoter (proZmUbi depicted in SEQ ID N° 3134) with the Zea mays ubiquitin intron (intZmUbi, depicted in SEQ ID N° 3109, Christensen et al 1992) and the SV40NLS sequence (as depicted in SEQ ID N° 3173) and upstream of the mouse nuclear import NLS sequence and the 3' termination sequence terAtNos depicted in SEQ ID N° 3171.

Each guide sequence is cloned between the pTaU6 promoter (depicted in SEQ ID N° 3168) and the termination sequence TerRNApolIII (depicted in SEQ ID N°3169).

Each cassette expressing the endonuclease is cloned consecutively to the cassette expressing the corresponding guide sequence. A recombinant cassette expressing LbCpf1 and guide sequences directed to target-23 and target-71 is depicted in SEQ ID N°3167. A recombinant cassette expressing SpCas9 and guide sequences directed to target-58 and target-54 is depicted in SEQ ID N°3166.

Transformation is performed as in Example 6 except that all "Rf3 weak" lines as listed in Table 12 are transformed. Fertility assays to select lines with an "Rf3" phenotype are performed as in example 14.

Example 16: Evaluation of the CMS T. timopheevii Restorer Lines Fertility

Some wheat elite lines possess an ability to partially restore the fertility of the cytoplasmic male sterility Triticum timopheevii (T-CMS). The hybrid formed between a sterile CMS wheat line taken as female and the wheat restorer line taken as male can produce grain. Commercial lines as Allezy, Altamira, Altigo, Aristote, Osado, Cellule or Premio and Limagrain proprietary lines have been tested for their capacity to restore T-CMS. All lines have also been characterized for their fertility genotype.

Fertility tests have been conducted indoor, either in growth chamber or in greenhouse, under controlled growth conditions enabling a normal expression of fertility of the tested wheat plants. The fertility scores indicated have been calculated by dividing the total number of seeds threshed from a spike by the number of counted spikelets. The t-tests conducted were done by comparing the fertility scores of F1s made with a restorer and the fertility scores of a panel of elite inbred lines grown under the same conditions (633 spikes from 37 winter and spring elite lines; $\mu=2.36$, $\alpha=0.59$).

The results in Table 14 show that these lines act as partial restorer of fertility in a CMS hybrid. For example, the hybrids made with Allezy produce an average fertility of 0.99 grains/spikelets over 33 individual F1 spikes. This native ability to partially restore the fertility of the CMS T. timopheevii was previously identified in wheat accessions as Primepii or Maris Hunstmann (Bahl and Maan, 1973), and it is confirmed by our own internal data (See Table 14). Beside this supposedly wheat intrisic source of restoration, the hybridizations between Triticum timopheevii and Triticum aestivum conducted by Wilson (Wilson and Ross 1962) contributed to the introduction into wheat of further restorer genes which chromosome arm localization was identified through monosomic analysis (Bahl and Maan, 1973; Maan and al, 1984).

Following these initial works many breeding programs implemented worldwide aimed at creating restorer lines for the T-CMS such as TJB155 (BBSRC Small Grain Cereals Collection: 2072 to 2075), which ability to restore is also confirmed by our own internal data (Table 14).

L13 (available via Australian Grains Genebank: 90821), is a wheat restorer line selected from R113 (available via Australian Grains Genebank: 90819) which carries the restorer allele Rf4. It produces a low level of fertility restoration when crossed with CMS lines (0.85 seeds/spikelet on average). When compared with the fertility scores of a panel of elite lines grown under the same conditions it appears that none of the tested putative restorer make possible a full restoration of fertility of the hybrid (p-values<0.05. table 14).

Table 14 also shows that restorer lines bearing two different Rf loci, are not able to fully restore the sterility induced by T-CMS. Therefore, all restorer lines tested, with single or two Rf loci are only partial T-CMS restorer lines.

TABLE 14 mean fertility scores and standard deviation from the indicated number of spikes. The first column indicates the name of the male line taken as pollinator for the F1 cross. All the data (except for Elite inbred lines) presented are from the created F1 crosses between the listed lines and a CMS tester. "Elite inbred lines" data refers to a panel consisting of 37 winter and spring elite lines. The t-test was implemented comparing the mean of fertility for each of the F1 crosses with the mean of the fertility scores of a panel of 633 spikes of elite inbred lines bearing fertile cytoplasm.

|  | Haplotypes | SPIKES | FERTILITY | STD DEV | P-VALUE |
| --- | --- | --- | --- | --- | --- |
| ALLEZY | Rf3 | 33 | 0.99 | 0.89 | 3.00E-33 |
| ALTAMIRA | Rf3 | 20 | 1.48 | 1.1 | 4.00E-10 |
| ALTIGO | Rf3 | 47 | 0.71 | 0.55 | 1.00E-63 |
| ARISTOTE | Rf3 | 37 | 1 | 0.73 | 3.00E-37 |
| CELLULE | Rf3 | 10 | 1.25 | 0.99 | 5.00E-09 |
| MARISHUNSTMANN | Rf3 | 16 | 1.26 | 0.88 | 7.00E-13 |
| OSADO | Rf3 | 9 | 1.52 | 0.68 | 2.00E-05 |
| PREMIO | Rf3 | 12 | 1.21 | 1.03 | 8.00E-11 |
| PRIMEPII | Rf3 | 51 | 1.55 | 0.75 | 2.00E-19 |

TABLE 14-continued mean fertility scores and standard deviation from the indicated number of spikes. The
first column indicates the name of the male line taken as pollinator for the F1 cross.
All the data (except for Elite inbred lines) presented are from the created F1 crosses
between the listed lines and a CMS tester. "Elite inbred lines" data refers
to a panel consisting of 37 winter and spring elite lines. The t-test was implemented
comparing the mean of fertility for each of the F1 crosses with the mean of the fertility
scores of a panel of 633 spikes of elite inbred lines bearing fertile cytoplasm.

|  | Haplotypes | SPIKES | FERTILITY | STD DEV | P-VALUE |
|---|---|---|---|---|---|
| TJB155 | Rf3 | 27 | 1.7 | 0.66 | 2.00E−08 |
| R204 | Rf1 + Rf7 | 59 | 2.09 | 0.51 | 6.00E−04 |
| L13 | Rf4 | 12 | 0.85 | 0.38 | 4.00E−18 |
| R0929D | Rf3 + Rf7 | 18 | 1.83 | 0.62 | 1.63E−04 |
| R0936T | Rf1 + Rf3 | 4 | 1.76 | 0.11 | 4.06E−02 |
| ELITE inbred lines |  | 633 | 2.36 | 0.59 |  |

Example 17: Fine Mapping of the Genomic Region Containing Rf1, Rf3 and Genetic Mapping of Rf4 and Rf7 Genetic Determinants A. Fine-Mapping of the Genomic Region Containing Rf1 Genetic Determinants Three F2 mapping populations segregating for Rf1 (R197xKalahari, R204xAlixan and R0932ExAltigo) encompassing 210, 218 and 212 individuals respectively were phenotyped as described in example 1 and genotyped with 18100 SNP markers using Limagrain's internal genotyping platform. Fertility of R204 and R197 lines is genetically associated to Rf1 and Rf7 locus. Fertility in R0932E line is associated to Rf1 locus.

Rf1 was first mapped on the short arm of the chromosome 1A between 4 cM and 10.9 cM on Limagrain's internal consensus map and physically delimited by SNP markers cfn1087371 and cfn0530841. These two SNP markers delimit the largest possible interval defined by the three mapping populations (see FIG. 8).

Following, joint analysis of the three mapping populations and phenotyping of the individual F2 recombinant plants on derived F3 families validated the QTL position and delimited Rf1 interval between 7 cM and 8.9 cM on Limagrain's internal consensus map and physically delimited by SNP markers cfn1082074 and cfn0523990. We used the genomic resources of the IWGSC Whole genome assembly, 'IWGSC WGA' (available from June 2016 from the URGI IWGSC repository) to anchor the locus to the wheat genome reference physical map. The left border (cfn1082074) was anchored on the IWGSCWGAV02_1AS_scaffold44309 scaffold and the right border (cfn0523990) was anchored on the IWGSCWGAV02_1AS_scaffold47238 scaffold.

Next, we decided to enlarge the population sizes to fine-map the locus and screened 2976 and 3072 F3 lines from R197xKalahari and R204xAlixan derived from F2 plants heterozygote at the locus respectively. Phenotyping and analysis of recombinant plant progenies within the interval redefined a smaller mapping interval between 7.5 and 8.8 cM delimited by cfn0522096 and cfn0527067 SNP markers on the IWGSCWGAV02_1AS_scaffold44309 scaffold and the IWGSCWGAV02_1AS_scaffold47238 scaffold respectively.

B. Fine-Mapping of the Genomic Region Containing Rf3 Genetic Determinants

Three F2 mapping populations (TJB155xAnapurna, 2852xAltamira, and AH46xR0946E) encompassing 217, 135, and 246 individuals respectively and a doubled-haploid (DH) population (H46xR934F) consisting of 140 individual plants segregating for Rf3 were phenotyped as described in example 1 and genotyped with 18100 SNP markers using Limagrain's internal genotyping platform. Sources of Rf3 locus are TJB155, Altamira and R0946E.

Rf3 was first mapped on the short arm of the chromosome 1B between 18.9 cM and 24.2 cM on Limagrain's internal consensus map and physically delimited by SNP markers cfn0554333 and cfn0560679. These two SNP markers delimit the largest possible interval defined by the four mapping populations (see FIG. 9).

Following, joint analysis of the four mapping populations and validation of the phenotype of the individual F2/DH recombinant plants on derived F3 families validated the QTL, genetically delimited the locus between 22.2 cM and 22.7 CM on Limagrain's internal consensus map and physically delimited the Rf3 interval between SNP markers cfn0436720 and cfn0238384. We used the genomic resources of the IWGSC Whole genome assembly, 'IWGSC WGA' (available from June 2016 from the URGI IWGSC repository) to anchor the locus to the physical map. The left border (cfn0436720) was anchored on the IWGSCWGAV02_1BS_scaffold35219 scaffold and the right border (cfn0238384) was anchored on the IWGSCWGAV02_1BS_scaffold5117 scaffold.

Next, we decided to enlarge the population sizes to fine-map the locus and screened 2496 and 672 plants from TJB155xAnapurna and AH46xR0946E derived F2 plants heterozygote at the locus. Analysis of recombinant F3 plant progenies within the interval redefined a smaller mapping interval between 22.5 and 22.7 cM delimited by cfn1249269 and BS00090770 SNP markers on the IWGSCWGAV02_1BS_scaffold35219 scaffold and the IWGSCWGAV02_1BS_scaffold5117 scaffold respectively.

C. Mapping of the Genomic Region Containing Rf7 Genetic Determinants

We crossed R197 (harboring Rf1 and Rf7 locus) and Primepii (harboring Rf3 locus) and then derived a population of 176 plants from individuals that were rf1 and rf3, which means not carrying the restorer alleles at the loci Rf1 and Rf3. The plants were genotyped with 18100 SNP markers using Limagrain's internal genotyping platform and phenotyped as described in example 1. We mapped the Rf7 locus on chromosome 7BL. Moreover, internal genotyping data showing a strong genetic divergence suggests the presence of an exotic chromosomal fragment which is stably transmitted through generation. We identified a large QTL ranging from 45 CM to 88 cM on chromosome 7B on Limagrain's internal consensus map with a peak on 46.7 CM (cfn0919993 with LOD score of 3.37E-40). First expertise of the recombinant plants suggests the Rf7 gene could be located between cfn3407185 and W90K_RAC875_c33564_120 markers delimiting a mapping interval of 0.3 cM between 46.7 CM and 47 cM on Limagrain's internal consensus map.

D. Mapping of the Genomic Region Containing Rf4 Genetic Determinant

A mapping population from the cross between AH46 and L13 (harboring Rf4 locus) consisting of 124 individual plants segregating for Rf4 was genotyped with 18100 SNP markers using Limagrain's internal genotyping platform and phenotyped as described in example 1. A QTL that we named Rf4 was identified on chromosome 6B between 0 cM to 65 cM on Limagrain's internal consensus map with a peak on 43.3 cM (cfn0393953 with LOD score of 1.08E-13). Moreover, internal genotyping data showing a strong genetic divergence suggests the presence of an exotic chromosomal fragment which is stably transmitted through generation. It is expected that the rate of recombination be very low within this chromosomal region and, consequently, any marker in linkage with cfn0393953 is considered to be associated with Rf4 locus.

Example 18: Identification of SNP Associated with the Rf Genes and its Use in MAS We constructed a BAC library with a DH line comprising Rf1, Rf3 and Rf7 alleles. This library was used for the identification of BAC clones within the Rf1 and Rf3 QTL intervals. More specifically, we identified and sequenced and genetically validated 3 BAC clones within the Rf1 region and 3 BAC clones within the Rf3 region. The BAC sequences were compared to Chinese Spring reference genome for SNP discovery. We then saturated Rf1 and Rf3 mapping intervals by mining available SNPs from public genomic resources and the newly discovered SNPs from sequenced BAC clones.

Screening for polymorphic and informative SNP markers on a diversity panel consisting of 83 wheat elite plants and known restorers for Rf1, Rf3, Rf4 and Rf7 identified a set of tightly linked markers localized within or in the immediate flanking regions of the Rf1, Rf3, Rf4 and Rf7 mapping intervals. These SNP markers can be used alone and/or in haplotype to select for Rf or rf plants in MAS breeding schemes (FIG. 10A and FIG. 11A). Allele information, marker sequences and primer information are provided in Table 15. Following, smaller sets of 2-3 markers of high quality were chosen to follow the traits in MAS breeding schemes.

As an example, the identification of the presence of the Rf1 locus in the genome of a plant is achieved by using either the marker 276113_96B22_97797 or 104A4_105588 (FIGS. 10A and B).

Similarly, the identification of the presence of the Rf3 locus in the genome of a plant is achieved by using either the marker 136H5_3M5_7601 or 136H5_3M5_89176 (FIG. 11A, 11B, 11C, 11D and Table 15). However, any marker listed on the FIG. 11A can be used to distinguish the maintainer lines from the restorer lines if they are polymorphic in the germplasm. As an example, in the Table 16, the presence vs absence of the Rf3 locus is achieved by using either the marker cfn1246088 or IWB72107

The identification of the presence of the Rf7 locus in the genome of a plant is achieved by using the markers cfn0917304, cfn0919993 and cfn0920459 (Table 17). In this case the 3 markers might be used in haplotype to distinguish restorer plants from maintainer plants. Thus the haplotype TGC would identify the restorer plants.

Finally, the identification of the presence of the Rf4 locus in the genome of a plant is achieved by using the markers cfn0393953 and cfn0856945 (Table 18).

TABLE 15

Haplotypes of a series of restorer lines and maintainer lines at the locus Rf3 for 2 SNP markers. Those 2 SNP markers makes possible to fully distinguish the maintainer lines from the restorer lines (including the elite lines Altamira, Cellule, Premio and the accessions TJB155 and Primepi).

| CODE | R: restorer/ M: maintainer | Rf alleles | 136H5_3M5_7601 | 136H5_3M5_89176 |
| --- | --- | --- | --- | --- |
| LGWR16-0016 | R | homozygous Rf3 | T | A |
| LGWR16-0026 | R | homozygous Rf3 | T | A |
| ALTAMIRA | R | homozygous Rf3 | T | A |
| CELLULE | R | homozygous Rf3 | T | A |
| TJB155 | R | homozygous Rf3 | T | A |
| ALLEZY | R | homozygous Rf3 | T | A |
| PREMIO | R | homozygous Rf3 | T | A |
| PRIMEPI | R | homozygous Rf3 | T | A |
| AIGLE | M | homozygous rf3 | C | G |
| AIRBUS | M | homozygous rf3 | C | G |
| ALHAMBRA | M | homozygous rf3 | C | G |
| ALIXAN | M | homozygous rf3 | C | G |
| AMADEUS | M | homozygous rf3 | C | G |
| ANAPURNA | M | homozygous rf3 | C | G |
| APACHE | M | homozygous rf3 | C | G |
| ARKEOS | M | homozygous rf3 | C | G |
| ARLEQUIN | M | homozygous rf3 | C | G |
| ARTDECO | M | homozygous rf3 | C | G |
| ARTURNICK | M | homozygous rf3 | C | G |
| ATOMO | M | homozygous rf3 | C | G |
| AVENUE | M | homozygous rf3 | C | G |
| CEZANNE | M | homozygous rf3 | C | G |
| CROISADE | M | homozygous rf3 | C | G |
| FRUCTIDOR | M | homozygous rf3 | C | G |
| GAZUL | M | homozygous rf3 | C | G |
| HERMANN | M | homozygous rf3 | C | G |

TABLE 15-continued

Haplotypes of a series of restorer lines and maintainer lines at the locus Rf3 for 2 SNP markers. Those 2 SNP markers makes possible to fully distinguish the maintainer lines from the restorer lines (including the elite lines Altamira, Cellule, Premio and the accessions TJB155 and Primepi).

| CODE | R: restorer/<br>M: maintainer | Rf alleles | 136H5_3M5_7601 | 136H5_3M5_89176 |
|---|---|---|---|---|
| HORATIO | M | homozygous rf3 | C | G |
| KALAHARI | M | homozygous rf3 | C | G |

TABLE 16

Haplotypes of a series of restorer lines and maintainer lines at the locus Rf3 for 2 SNP markers. Those 2 SNP markers makes possible to fully distinguish the maintainer lines from the restorer lines.

| CODE | R: restorer/<br>M: maintainer | Rf alleles | cfn1246088 | IWB72107 |
|---|---|---|---|---|
| ALTIGO | R | homozygous Rf3 | A | A |
| ARISTOTE | R | homozygous Rf3 | A | A |
| OSADO | R | homozygous Rf3 | A | A |
| AIGLE | M | homozygous rf3 | C | G |
| AIRBUS | M | homozygous rf3 | C | G |
| ALHAMBRA | M | homozygous rf3 | C | G |
| ALIXAN | M | homozygous rf3 | C | G |
| AMADEUS | M | homozygous rf3 | C | G |
| ANAPURNA | M | homozygous rf3 | C | G |
| APACHE | M | homozygous rf3 | C | G |
| ARKEOS | M | homozygous rf3 | C | G |
| ARLEQUIN | M | homozygous rf3 | C | G |
| ARTDECO | M | homozygous rf3 | C | G |
| ARTURNICK | M | homozygous rf3 | C | G |
| ATOMO | M | homozygous rf3 | C | G |
| AVENUE | M | homozygous rf3 | C | G |
| CEZANNE | M | homozygous rf3 | C | G |
| CROISADE | M | homozygous rf3 | C | G |
| FRUCTIDOR | M | homozygous rf3 | C | G |
| GAZUL | M | homozygous rf3 | C | G |
| HERMANN | M | homozygous rf3 | C | G |
| HORATIO | M | homozygous rf3 | C | G |
| KALAHARI | M | homozygous rf3 | C | G |

TABLE 17

Haplotypes at the Rf7 locus for the restorer lines LGWR16-0016 and LGWR16-0026 and for a series of maintainer lines. "—" scores correspond to dominant markers with no amplification in several maintainer lines.

| CODE | R: restorer/<br>M: maintainer | Rf alleles | cfn0917304 | cfn0919993 | cfn0920459 |
|---|---|---|---|---|---|
| LGWR16-0016 | R | homozygous Rf1, Rf3, Rf7 | T | G | C |
| LGWR16-0026 | R | homozygous Rf1, Rf3, Rf7 | T | G | C |
| AIGLE | M | homozygous rf1, rf3, rf7 | G | — | G |
| AIRBUS | M | homozygous rf1, rf3, rf7 | T | G | G |
| ALHAMBRA | M | homozygous rf1, rf3, rf7 | G | T | G |
| ALIXAN | M | homozygous rf1, rf3, rf7 | T | T | C |
| AMADEUS | M | homozygous rf1, rf3, rf7 | G | G | C |
| ANAPURNA | M | homozygous rf1, rf3, rf7 | G | T | G |
| APACHE | M | homozygous rf1, rf3, rf7 | G | T | C |
| ARKEOS | M | homozygous rf1, rf3, rf7 | G | T | G |
| ARLEQUIN | M | homozygous rf1, rf3, rf7 | G | G | C |
| ARTDECO | M | homozygous rf1, rf3, rf7 | G | — | G |
| ARTURNICK | M | homozygous rf1, rf3, rf7 | T | T | G |
| ATOMO | M | homozygous rf1, rf3, rf7 | T | T | G |
| AVENUE | M | homozygous rf1, rf3, rf7 | T | T | C |
| CEZANNE | M | homozygous rf1, rf3, rf7 | G | T | G |
| CROISADE | M | homozygous rf1, rf3, rf7 | G | T | C |
| FRUCTIDOR | M | homozygous rf1, rf3, rf7 | G | T | G |

TABLE 17-continued

Haplotypes at the Rf7 locus for the restorer lines LGWR16-0016 and LGWR16-0026 and for a series of maintainer lines. "—" scores correspond to dominant markers with no amplification in several maintainer lines.

| CODE | R: restorer/ M: maintainer | Rf alleles | cfn0917304 | cfn0919993 | cfn0920459 |
|---|---|---|---|---|---|
| GAZUL | M | homozygous rf1, rf3, rf7 | — | G | C |
| HERMANN | M | homozygous rf1, rf3, rf7 | T | G | G |
| HORATIO | M | homozygous rf1, rf3, rf7 | G | — | G |
| KALAHARI | M | homozygous rf1, rf3, rf7 | G | — | G |

TABLE 18

Haplotypes at the Rf4 locus for the restorer lines L13 and R113 and maintainer lines.

| CODE | R: restorer/ M: maintainer | Rf alleles | cfn0393953 | cfn0856945 |
|---|---|---|---|---|
| LGWR16-0016 | M | homozygous rf4 | T | T |
| LGWR16-0026 | M | homozygous rf4 | T | T |
| AIGLE | M | homozygous rf4 | T | T |
| AIRBUS | M | homozygous rf4 | T | T |
| ALHAMBRA | M | homozygous rf4 | T | T |
| ALIXAN | M | homozygous rf4 | T | T |
| AMADEUS | M | homozygous rf4 | T | T |
| ANAPURNA | M | homozygous rf4 | T | T |
| APACHE | M | homozygous rf4 | T | T |
| ARKEOS | M | homozygous rf4 | T | T |
| ARLEQUIN | M | homozygous rf4 | T | T |
| ARTDECO | M | homozygous rf4 | T | T |
| ARTURNICK | M | homozygous rf4 | T | T |
| ATOMO | M | homozygous rf4 | C | T |
| AVENUE | M | homozygous rf4 | T | T |
| Cezanne | M | homozygous rf4 | T | T |
| CROISADE | M | homozygous rf4 | T | T |
| FRUCTIDOR | M | homozygous rf4 | T | T |
| GAZUL | M | homozygous rf4 | — | T |
| HERMANN | M | homozygous rf4 | T | T |
| HORATIO | M | homozygous rf4 | C | T |
| KALAHARI | M | homozygous rf4 | T | T |
| L13 | R | homozygous Rf4 | C | G |
| R113 | R | homozygous Rf4 | C | G |

Sequences of Snp Markers:

TABLE 19

Marker sequences and SNP position in sequence.
SEQUENCES OF SNP MARKERS

| Marker ID | AlleleX | AlleleY | Sequence | SEQ ID NO: |
|---|---|---|---|---|
| cfn0523072 | C | T | CAAAGGCTTGACAATGATAATGCCCCCGAATC TTG[C/T]GATAGACCTCATGCGCTAGAGTTGTT TTCCTCAAT | 3187 |
| cfn0523109 | A | C | GACAAAGTTGAGGTGAACAAAACAGGCCTAC AATC[A/C]GCTAACTTACGTATATCCACATTAG CACACACCAC | 3188 |
| 276I13_96B22_97797 | C | T | AAATTCGACAAGTACTATGGCTATGTCTCTGA ATG[C/T]TTGTTTGGTTTTATTTGTCTATATTGT CGTTGTAT | 3189 |
| cfn0522096 | C | G | ATGCAAAGTAGTACTCGTAGAGAGTTAACACA GAC[C/G]AGTGATTTATTGGGTGGTATTCTACT TGATATTTG | 3190 |
| cfn0527763 | T | C | ATAAAGAAAAGTAGAGGAAGCTTATGAATAA AATGGAAAGGAATTCAAAATTGCCGATAAA TATAAAACTCATAACAAATCTAGCCACGCAAA | 3191 |

TABLE 19-continued

Marker sequences and SNP position in sequence.
SEQUENCES OF SNP MARKERS

| Marker ID | AlleleX | AlleleY | Sequence | SEQ ID NO: |
|---|---|---|---|---|
| | | | TGCCCG[T/C]GCCGCTCTGCTCGTTTGTACATG TCTCGGTGGACAAGGAAGAACCCAACAATTGC ACAGGTCAATCTTATCCAGCAAAACAAGGAA GCAAACCAAACAGG | |
| 104A4_105172 | TG | CA | ATGTTGCCTCTCGCTAGCCGCTGTCGMACCCA ATGAATAATGTT[TG/CA]TGGGTTCTGGCTCCG AGAGGATGGCCGGCTYCCC | 3192 |
| 104A4_105588 | A | C | GTTCCTTGTGACATGTACTCATA[A/C]ACAAGA GCCATATACTCCCCATCCTTGCA | 3193 |
| cfn0373248 | T | A | GACATAATGTGTAATAACAGCCCATAATGCAA TAAATATCAATATAAAAGCATGATGCAAATG GACGTATCATTGCCACGRAAAAAATCTCACAA GATG[T/A]GACCATTTGATCCTCRTAATTGTTG TTCTAGACCCACTCCTAAGTMTAACATTCTTT ATGTCTATYCTTCAAATCCCGAAGAGTAATGA AAACTATCGAA | 3194 |
| cfn1097828 | T | C | CCATGAGTACCCGCTACTATCGATCTCCCTCCT CCCTGTAGGAGGCCTACGAACGATGCCCTCAG GTCCTGCTTCCTCTCGGTAGCGATGGATCCAC CTG[T/C]GGTTGCTCTCTCAGGAACCAGTGTTG GCGGCGGCTCATCCGGGGCGCTGGATCTTGGT GATGTGCTGGAACAACTCAACTTGGAAGACGA AGAATTTGAT | 3195 |
| cfn0527067 | A | G | GACAATATGATTCACCCTAGATCCTTCACCTT ACA[A/G]TTCGAAAAAAATAAAAGAACAAAAG TAATTTGACA | 3196 |
| cfn0528390 | A | G | ACGAAGATGAGGAAGGTCTTCATGTTGGGTTT ATG[A/G]TTACTAATACTTGCTTGGAATAGATG TTTTTGATC | 3197 |
| BWS0267 | A | G | GTTACCCCAATATGCTCCCTCCTTGCACATTTT CTTCAGCTGCATAAAAAMCAGAATACC[A/G]C ATCAGTTGCCTGAACCTTAACGCAGGTGCAGA AATAAGGCGACATAATTTYCACTAATC | 3198 |
| cfn0527718 | C | T | AGGAAAATAAATTGTTCACAACATGGACATGA GAA[C/T]GGGGCAACCAAAAAGGGAAGAACAT TGGAGGAAAC | 3199 |
| cfn0524469 | G | T | TTTGTACTGCACGTAGTAAGTATTGATTTTTCT GT[G/T]TGCTCTCTGTGGACTTAGATTTGAAAA TTGGCCTT | 3200 |
| cfn0524921 | A | G | ATGCACATTGTTTCCATGTTAAGCTTATATTGT GC[A/G]TAACTCAAAAGATTGAAATGGAATTA CCAAAGGGC | 3201 |
| cfn1122326 | C | T | ACTGACTGTTGGAATCTGATTAAGACGCTGGA GAA[C/T]CCGAGCCAAGATATGTCACGACTAG GCCATCTGGA | 3202 |
| cfn1252000 | A | G | AATCAGATCCTGTTAATGCTGTAGCCATTCTTG CA[A/G]GCGACACCTTGTCCCAGTCGTCTTATG GGCACTTA | 3203 |
| IWB14060 | A | G | GGCAGAGCCGGTCGACGGAGAGGAGCGCCAT TCGACGCGTCTTCCGCAAT[A/G]TGTTTGCCTG CTTCGGCCGCGGCCATTCGGCGAGCTCCCACG CTTCGTCC | 3204 |
| cfn1249269 | A | G | CGTTTAAAAGAACACAAATGTGGCCCTAGTGA TCA[A/G]GTACACATATTGTCACCTCTTTGAA TCTTACTTA | 3205 |
| 219K1_166464 | C | T | CGGGCTGATGAGGCTCTCGACGTGCTGCTTCA CAGGATGCCTGAGCTGGGCTGCAC[C/T]CCCA ACGTGGTGGCATATACCACGGTCATCCACGGC TTCTTTAAGGAAGGC | 3206 |

TABLE 19-continued

Marker sequences and SNP position in sequence.
SEQUENCES OF SNP MARKERS

| Marker ID | AlleleX | AlleleY | Sequence | SEQ ID NO: |
|---|---|---|---|---|
| 219K1_158251 | G | A | GCGCTATCCGGCGTCGTGTTCCCTCTTGGGGG AATCGTCCTGGAGATGGATCCGGTCA[G/A]AG GGGCCCGTGATTTGTGAGGATGTGTGTGTTGT TTCCCGAAAGGCG | 3207 |
| 219K1_111446 | A | C | CTTTGACCTTAAATTCTTGTACTAATTTAGCAG AATCGTTCTTCGAGAAGCACTC[A/C]AAAAAT GGTTTGTCTTGGGTCTGTATCATATTTTCTCTG AACAAACAGGCGTGA | 3208 |
| 219K1_110042 | T | C | GACTTAGCCTCACACGGAATCGAGTCAACCAA TTCC[T/C]GTCGGTTTTGAGTGGCTCCCTTGAA GATGCAATCGTTTTCAGCATGGTCAGATTAAT CAGCGAGCGTGC | 3209 |
| 219K1_110005 | C | T | CATGTAGTGGCTGGCGTCTAAGCGCCTTTTCTT CTTCCAGCATCTA[C/T]GACTTAGCCTCACACG GAATCGAGTCAACCAATTCCTGTCGGTTTTGA GTGGCTCCCTTGAAGATG | 3210 |
| 219K1_107461 | A | C | GTCGTATATATTGTTTGTATTAAAAAGTTGTGT GTTTTG[A/C]GTCATAATTTTTAAAATATTATT ATGTCATTTTCAAATTCGCATCAAC | 3211 |
| 219K1_99688 | T | C | AATCTTCTTGACTTCATCCATCCGCCTTGTTGC CCTGCGCAAAATCAAACT[T/C]CCCCGTCCTTA TCATCAAGTCAGGTCCCGCCCTGGGCAGAGAG AG | 3212 |
| 219K1_37 | C | T | CGGCAGATATCACAAAGGGCTATCCTGGTGAA CAA[C/T]AAGATGGGTCAGAATTTGATAATGA AGCCTCAAGCCC | 3213 |
| cfn1270524 | A | T | AATAGATGCACGCATCGGCGACCATTTTTTAG TACTTTTTGCCTTTTTTGAAAATTTTGTCATTA AAAGACAAATGCCTAGTCTATACCTGATAAAC TAA[A/T]ATCATACATAGAGAAAATGGTCATTT GGTTGAGTTTCGGTACATGCTGAGATGGTTGC ACTTCGGTGCATCTGCTTTGCTTCCATCACATC ATAATGTCT | 3214 |
| 136H5_3M5_7601 | T | C | GCTGCTTGTAGCGTCCCCCATGGCACCTG[T/C] GAAGAGGTTTTCGGCCACAGAGAAGGGGAAG GCTC | 3215 |
| cfn1288811 | T | G | AAAATTACTTTTCACGCGCTTCGTTGGTCTGAC AGTGCGAGCATAATTTTACTTTTTCTCAGTTTT ACTTAATTTGGTTAACCAAATCCTTTTTGATTT T[T/G]AACTAGAAAACCGAATGTCAAACATTG TGCAAATTTGGAAACTGAAACTGAAACCAAA AACCTAAAAAAATGATTAGTTTGTTTTTTTGTT CTTGTTTCG | 3216 |
| 136H5_3M5_89176 | A | G | gtatttCTTAGGATTTTCTCACCGGCATCTCC[A/G] TTTTTTGAGCAAGAGTATTTAAGGATGGTAGG C | 3217 |
| 136H5_3M5_89263 | C | T | AACAAAGATGCTAGTAAGAACATGAACCTAG TTGCTCATTTTTAACAACAATTGCCCACCAACC TGACATGCTCTTCCCATGTTCTTTTTTTGCTCA AAA[C/T]AGAGATGCTAGTCCAAATATTTTTCT AGTTGCTTACATTTTAAACAACAATTGCCTAC CATCCTTAAATACTCTTGCTCAAAAAACGGAG ATGCCGGTGA | 3218 |
| 136H5_3M5_138211 | T | A | AATACAGACTGGGTGCAAAGCCAAGATGAT[T/A] GTAAAATTGATTGATGGCCGTTGGGAGGT | 3219 |
| cfn0556874 | C | T | TGTAAAGAAGCTTAACCAGGAAAGCTATCAG GGCCATAGGGAATGGCTGGTTAGTGACAATTT TGCCTGCTGGAAATGGGATTTCTTGTTTATTTC AGTT[C/T]TGCATTGTGTCTGACATGCTCTTTCT TTTGGGCGCAGGCTGAAGTGAATTACCTTGGA CAACTATCGCACCCGAATCTTGTAAAGCTCGT TGGGTACTGT | 3220 |

TABLE 19-continued

Marker sequences and SNP position in sequence.
SEQUENCES OF SNP MARKERS

| Marker ID | AlleleX | AlleleY | Sequence | SEQ ID NO: |
|---|---|---|---|---|
| 136H5_3M5_64154 | T | C | TGGCGGAGCTGGGGCTGTTCCTCCTACGCAGG CGAAACTTCGCCGCGATAAA[T/C]GGAACTAT CATCAGGTTCCCCGATGATCCATACG | 3221 |
| 136H5_3M5_68807 | A | G | ACAAGCAACCGAGACAAGTTGCTCTTAATTAT CTGTGCGT[A/G]CACCTCTAAGTCTTAACCTGA CGTAACCAACCAACCGTGT | 3222 |
| 136H5_3M5_77916 | A | G | GATGGTTACAAGGCATGCATAGCAAGTAGAGT TAACTTATCAAGTTATT[A/G]GTATTTTTCTTCT GTGGTACTTAGAGTCTAMAGCTTGAGC | 3223 |
| cfn1246088 | A | C | AATGGAAGCTGATGTGCGTTAGCGATAAAGCA ACAGCGATAACGACGCATGGATCACCATGCTA CTTGGGGAAGCAGGGACATCTGATGAGCCAG CATAC[A/C]CCCAGATATGTGTCTTTCCAAATT CCACGTCCAACAGATGAGCTATAAATTAATG CCACCTTCCTCCTACAGCTAAATACTCCATCCG TTTCATAATGT | 3224 |
| cfn1287194 | G | A | CAGAGGCATTCGTGAATTGGGCGAAATCAGA AGCAAGGAGCAGCGATGTTCAGCGCAGAAGG CACTGGGAGGGGATTCCAGGGAGGCTGCCCA CCAGCCC[G/A]CCATCAGATACGGAGGAGGTG GATCCATGGCCCTACCTGTGTCCTGCGCCGAA TCTGGACTGTGGTAACTACAGCGCCTGAATCT AGAGGTTCAGCCTGG | 3225 |
| cfn1258380 | A | C | GATCCATCTCCCTTAATAATTTTGCTATTGGTA TTGGGTATGGACATCTGAAGTGAAGGTTACGG CCGATTTATAGGAGTGATAGCACCACACAATT CAT[A/C]AGAGCATCTGCAATAGATGAGTAGA TGTAAAACTACTTAACTTTTACATCTCCGGGCC TAAAAACGCATCTGTAATAAGATAATGTAGAT GTAAAGAAAA | 3226 |
| IWB72107 | A | G | CGACGACGACGAGGATGCCGAGTTTGATGAC ATGGAGGATTATATCGACG[A/G]cgcggactgggacg ccgacatgtatgatgatgtgttcgatgtctgaagga | 3227 |
| BS00090770 | C | T | TAGCCGTAGGTCGTAGCACATAGCCGTTTA[C/T] GTAATGCATAGTTGTCCGAAGGAATGTTTC | 3228 |
| cfn1239345 | A | G | TAACCTGGGGCTTCTTTTTTCTCCCTATAATAT GG[A/G]CTGCCCTTTTAAGAAGGAACTGCAGC GAGGGTGCA | 3229 |
| cfn0917304 | G | T | GACTACGCGTTCCTCCCGGTGGTGGCGCTCTA CCC[G/T]TTGTGTTGCCTTTCTCCAAGCAGTTGT GCCCTTCG | 3230 |
| cfn0919993 | G | T | ATATCTTTACAAGTCATCGACTTACATGCTTCT TT[G/T]TATTATATGCACCTATGCAGTACTTGTT AATGGGT | 3231 |
| cfn0920459 | C | G | GATGATATAACCGTAGCCAAGGAAGCCCAGA TTTT[C/G]TTCTGTGTATCTATAGGAGCTTAATT AGGAGGAGG | 3232 |
| cfn0393953 | C | T | AGTATATAAAAAAACAAGTTGTCACCCAGATG AAT[C/T]CGAAACTATGTCAATGTCGACGGTGA GTGTGGACC | 3233 |
| cfn0856945 | G | T | GGACATCGGCACATGCTTTATTACTGATCTGA TTT[G/T]TTGACTGTTTATTTTAGGTTTGCCTAC ACCACTGA | 3234 |
| cfn1291249 | T | G | ATGGTTGAATATGTGACTGCATTTGGACTCAC TCCTTGTTTCTGCATTTCATTGAAGATAAGCAT GGCCTTATCAAGCTTCCCAGATTTAGCATGTG CAT[T/G]AATCAGTATGTTGAAGATACGACAGT CAGGTAGAATGCAGTATCTTTCCATTGAATTG AAGAGATTAATCATATCAACTAAGCATCCTTC GGTGGCATAC | 3462 |

TABLE 19-continued

Marker sequences and SNP position in sequence.
SEQUENCES OF SNP MARKERS

| Marker ID | AlleleX | AlleleY | Sequence | SEQ ID NO: |
|---|---|---|---|---|
| cfn0231871 | G | T | GGAGGCGCCTACTGTATTAAATTAGCTAGTGT GGC[G/T]TGTTTGAGGATAATGGCACATATACC TTGGCGGTG | 3463 |
| cfn0867742 | G | T | TCCAGGCAGGGGGCATCCTCGACAATGATTTC ATC[G/T]AAGCTGCATCCCCATTCCATCACGAC GCGGAGGCT | 3464 |
| cfn0523990 | G | T | TGTAAGCTAACTATACATGAAGAGTGCAGGCA CAC[G/T]AAAACGTTCATCCTGAAGTACAAGA GTTATTTTGG | 3465 |
| cfn3126082 | A | C | GGAGAAAGGCGAGATTTTAGCACCTAACGCC GCAA[A/C]CCAGATCAAATCGCTGTCCCTTT | 3466 |
| W90K_RAC875_c33564_120 | A | G | AACCTTGGAAGCTATCATTGCGCACTTGAAGA GCA[A/G]TAGTGTGGACATTCCTGTTTATGCTT GGAGCTTAG | 3467 |
| cfn3407185 | A | G | CGCAGGCAGCGGGCATGTATCCTCGTCTGACG GAT[A/G]CCCAGATTATTAAACTGTCACCCTGC ACGCCTGCA | 3468 |
| S100069923 | G | A | GAGGCTAATCCCGACGTGCCACATTGAGCACG TGTGTTCTTGCTGTGGCCTGGTCGAAAGACAT GACGCATGCACGTGCCCCACGCCTCACACGGC TTGGGTTCTCGCCTGTCCGGTGCTCGACGGAC CAGTACATATACGCGAGCGCTCCT[G/A]GCCA CCTCAGTTCATCACACTTCACTGCAGTACAAG GCCTCGGCTCTCGGCAGACTCCTCATTGCTGCT TCTGCTAGTGAAAAGAGAGATTCTTCAGCGCT GCTCCTGAAAGAGATAAGAAATACGATGGCA ACAATGGTCAGAG | 3469 |
| S3045171 | G | A | ACTTACTGCGCGCAGACGTTGCAGCTCTTCCT GCAGAAGCCAGGAGCTTCCTTGGTGCCCACCA TATAGTTGGGGTTCTTGGCACACTCCCCA[G/A] CGGCAGCCCACTGCGAGCAGAGGACATTCTCG TCCTCGCAGCCGTCACCGGAGCCT | 3470 |
| S3045222 | T | C | AAGCAAGCTACGCGTTGCTCAAAAAAAAAAA AAGCAAGCAAGCTACGCTGATCAAAGGCTGA ATAGTCCAGAGTTACAGGACATGGCTACTCTG CAGC[A/G]CCCAGCAAGCTTACTACTTAGGTTG GTGGAGAAGCAGCACCCACTCGAGACTCGAC AAGCAACCTTGGACGTTCTACTCGCCAGTGCA TTGCTGCTTTACC | 3471 |
| cfn1087371 | A | G | ACCAGAGAAAGAGAGGGGAACTTTGGGTATA CACC[A/G]CATTACCCTAGTGAAAGAAGAAGG GGGTATTATGT | 3472 |
| cfn0436720 | A | G | GAAGGGTCCACTGAGAATTAAGGATGCATTCT TTC[A/G]ATTTGGTATATTTGTTGTAAGGAATG AAGAATCGG | 3473 |
| S100067637 | G | C | TTTCGTGGCGGGGATCTCGTGCCGGTCGAGG AGGTCCACCTCCAGCGAATTCTGCAGCAACCA ACACAAACAGGCCCAAATGTCCGAATTCAGA GCA[C/G]AGCCCGACCGACCGACCGCGAAATC GCGCGGCATGGCGTTGGCGTTTGGCGTTGGCG AGAAGGAAAAAGGCACTCTATGCAGACCTTA GCTTGGTTATGGC | 3474 |
| cfn0554333 | C | G | TTGCCAAATTCACACCATCATTGATCTGGGGT ATC[C/G]TATGCCTATGTGATGCCTCTCACCTC TTTCTTCCC | 3475 |
| cfn0238384 | C | G | CCGTGAAACCTGTAAAAGATGTCTGTGTGTC TAG[C/G]AAAGCCCTAATTTTAATCACCCCGTA CGCCCCCCT | 3476 |

TABLE 19-continued

Marker sequences and SNP position in sequence.
SEQUENCES OF SNP MARKERS

| Marker ID | AlleleX | AlleleY | Sequence | SEQ ID NO: |
|---|---|---|---|---|
| cfn0530841 | C | T | GCAGCTTCTTGTTTATATATTCTCTTATCAGAA GT[C/T]GGGTAGAACAGCTAACGATGTGCTGCT CATTTCCT | 3477 |
| cfn1082074 | C | T | TGATCTTACTGATAAAATCCGGTTCAAATATA TAA[C/T]GGTGAGAAAAAATTAACCAGAGCGA GGCGAGACAT | 3478 |
| cfn0560679 | C | T | GTTCATGTACAATGATGTTTAACATTGGAACG GTC[C/T]GGGATCTGTTTGATCTATGCCCCCTT CAACGTCTT | 3479 |
| cfn0915987 | G | T | AAGTCTGCCATCCAGATCATTACCCAACGGCC AAT[G/T]GAGCCATGAGGTTTGCCTCGTTGCAC GTTTTGGCT | 3445 |
| cfn0920253 | A | C | GCAACAAAGCTGGTCATCCAAACATTTACATC GTT[A/C]GGCAGGCTTTCCGCCCAAACCATGCG GCCGACCTG | 3446 |
| cfn0448874 | C | T | TATGTAAAACCTCTTTGTTTCTAAATAGCTGCG GC[C/T]CGCTACCTAAATTTATGTTGAACCTAG AGGCACCC | 3447 |
| cfn0923814 | A | C | GTTCGGCAGAATCCAAGTCGCAAATGTAAGGT CAG[A/C]AAATGAATGATGATCATGATAATGA AAATCATAAG | 3448 |
| cfn0924180 | A | G | ACGTATGGAGCTTCCTCTTTTCATCATGCACCA TT[A/G]TGATCTCCCTCTTATTTTGTCTGAAGCC ATTCATG | 3449 |
| cfn0919484 | A | G | AGGTCATGAAAATGCAAGTGGCGAATCTTATC TCT[A/G]TTATACCATTTGGCAAAACAAAGGCG AGAGTTCTG | 3450 |

Example 19: Test of the Cumulative Effect of Rf Genes

To test the hypothesis of the cumulative effect of the restorer alleles and to identify the combination(s) of Rf genes that can produce a full fertility in the CMS hybrid, the SNPs linked to the 4 major loci mapped are used to create restorer lines combining the different restoring alleles. The 2 Rf alleles, 3 Rf alleles and 4 Rf alleles combinations (Rf1+Rf3, Rf1+Rf4, Rf1+Rf7, Rf3+Rf4, Rf3+Rf7, Rf4+Rf7, Rf1+Rf3+Rf4, Rf1+Rf3+Rf7, Rf3+Rf4+Rf7 and Rf1+Rf3+Rf4+Rf7) can be created employing different breeding techniques such as pedigree breeding, backcross, single-seed descent or double haploid.

In the example exposed 2 double-haploid lines from the cross TJB155/R204 were created: LGWR16-0016 and LGWR16-0026. Those two lines carry the restorer alleles Rf1, Rf7 (donor R204) and Rf3 (donor TJB155) and are alloplasmic for the cytoplasm from T. timopheevii (donor TJB155).

LGWR16-0016 and LGWR16-0026 have winter growth habits and show a normal fertility (LGWR16-0016:2.54 seeds/spikelet, average over 29 individual spikes. LGWR16-0026:2.33 seeds/spikelet, average over 40 individual spikes). LGWR16-0016 and LGWR16-0026 were used as pollinators in a series of crosses onto a series of A-line with elite background (14 A-lines for LGWR16-0016 and 16 A-lines for LGWR16-0026). The F1 plants originating from those crosses were assessed indoor for their fertility.

Fertility Assessment with the Main Tillers

The spikes from the hybrids produced with the restorer lines LGWR16-0016 yielded on average 45.4 grains and did show an average fertility of 2.44 grains/spikelet. The spikes from the hybrids produced with the restorer lines LGWR16-0026 yielded on average 44.7 grains and did show an average fertility of 2.37 grains/spikelet. Neither of these two groups differ significantly in their fertility distribution from the group formed by the elite lines (Table 20. T-test, P-values<0.05). The distribution of the fertility scores are, as a consequence, relatively similar between groups (see Table 20)

TABLE 20 fertility (expressed as number of seeds/spikelet) of a series of spikes from hybrids produced with the restorers lines LGWR16-0016 and LGWR16-0026 and from a panel of elite lines. The average number of seeds per spike are indicated in the column "SEEDS". The standard deviation "STD. DEV." are given for each of the three groups. The T-test p-value "P-Value" is given for the two groups of hybrids produced with LGWR16-0016 and LGWR16-0026: it indicates the statistical significance of the difference for the value "Fertility" between the group of hybrids ad the group of elite lines The spikes originate from the tallest tiller(s).

| | SPIKES | SEEDS | FERTILITY | STD. DEV. | P-VALUE |
|---|---|---|---|---|---|
| LGWR16-0016 | 164 | 45.4 | 2.44 | 0.43 | 0.090 |
| LGWR16-0026 | 206 | 44.7 | 2.37 | 0.45 | 0.692 |
| ELITES inbred | 637 | 44.1 | 2.36 | 0.59 | |

Fertility Assessment with all Tillers from F1 Plants

To be considered as complete, the restoration of fertility has to be observed in all the spikes formed by the hybrid plant. For that purpose, the integrality of the spikes of 56 F1 plants produced with LRWG16-0016, of 61 F1 plants produced with LGWR16-0026 and of 52 elite lines were assessed for their fertility and represent, per group, 294, 262 and respectively 288 individual spikes (Table 21). The 56 F1 plants produced with LGWR16-0016 produced on average 41.4 grains/spikes and did show an average fertility of 2.21 grains per spikelet (standard deviation 0.32). The 61 F1 plants produced with LGWR16-0026 produced on average 42.8 grains/spikes and did show an average fertility of 2.27 grains per spikelet (Table 5. Standard deviation 0.32). The fertility distribution of these two groups differ significantly from the fertility distribution of the groups formed by the elite lines (average number of seeds per spike: 38.4. Average fertility: 2.01. Standard deviation 0.44. see Table 21).

TABLE 21 average spike fertility (expressed as number of seeds/spikelet) of individual plants from hybrids produced with the restorers lines LGWR16-0016 and LGWR16-0026 and from a panel of elite lines. The average number of seeds per spikes are indicated in the column "SEEDS". The standard deviation "STD. DEV." are given for each of the three groups. The T-test p-value "P-Value" is given for the two groups of hybrids produced with LGWR16-0016 and LGWR16-0026: it indicates the significance of the statistical difference for the value "Fertility" between the group of hybrids ad the group of elite lines. On average the F1 plants produced with the restorer lines LGWR16-0016 and LGWR16-0026 formed 5.25 and respectively 4.3 spikes and the plants from the elite lines group formed on average 4.35 spikes.

| | PLANTS | SEED | FERTILITY | STD. DEV. | P-VALUE |
|---|---|---|---|---|---|
| LGWR16-0016 | 56 | 41.4 | 2.21 | 0.32 | 0.003 |
| LGWR16-0026 | 61 | 42.8 | 2.27 | 0.32 | 0.000 |
| ELITES inbred | 52 | 38.4 | 2.01 | 0.44 | |

Example 20: Development of Restorer Lines from Different Sources

With the help of the markers developed in the previous examples, new restorer lines comprising Rf1, Rf3 and Rf7 loci were obtained using different sources of restoration locus. Table 22 shows the list of these restorer lines and their characteristics.

LGWR17-0015 is a winter wheat double haploid line produced from the F1 plants from a complex cross: R0934F was first pollinated by Altigo, the created F1 R0934F/Altigo was then crossed with the F1 R197/Apache taken as male and the resulting four ways F1 "R0934F/ALTIGO//R197/APACHE" was then pollinated with the line Altamira. LGWR17-0015 inherited the T-CMS cytoplasm from the restorer line R0934F. LGWR17-0015 has been selected under local environment and is a fully fertile wheat line.

LGWR17-0022 and LGWR17-0157 are winter wheat double haploid lines arising from a complex cross: the F1 formed from the cross between the restorer lines R204 and R213 was pollinated with Aristote, the resulting 3-ways cross "R204/R213//Aristote" was then pollinated with the line NIC07-5520. LGWR17-0022 and LGWR17-0157 inherited the T-CMS cytoplasm from the restorer line R204. They have both been selected under local environment and are fully fertile wheat lines.

LGWR17-0096 and LGWR17-0154 are winter wheat lines developed by conventional pedigree breeding technique from the 3-ways cross R204/R213//ARISTOTE. LGWR17-0096 and LGWR17-0154 inherited the T-CMS cytoplasm from the restorer line R204. They have both been selected under local environment and are fully fertile wheat lines.

All lines have been genotyped with the markers as described above to check for the presence of Rf1, Rf3 and Rf7 haplotypes.

Representative seed samples for each line have been deposited before NCIMB Collection on 25 Sep. 2017. The NCIMB is located at Ferguson Building, Craibstone Estate, Bucksburn, Aberdeen, Scotland, UK, AB21 9YA.

TABLE 22

Full restorer lines data regarding pedigree, the process of selection, Rf haplotype identified by markers and NCIMB deposit number"HD": homozygous plant obtained after a Double Haploid process, "F6": homozygous plant obtained through six generations of self-crosses.

| CODE | PEDIGREE | SELECTION | HAPLOTYPE Rf | NCIMB deposit number |
|---|---|---|---|---|
| LGWR16-0016 | TJB155/R204 | HD | Rf1 + Rf3 + Rf7 | NCIMB 42811 |
| LGWR16-0026 | TJB155/R204 | HD | Rf1 + Rf3 + Rf7 | NCIMB 42812 |
| LGWR17-0015 | R0934F/ALTIGO//R197/APACHE///ALTAMIRA | HD | Rf1 + Rf3 + Rf7 | NCIMB 42813 |
| LGWR17-0022 | R204/R213//ARISTOTE///NIC07-5520 | HD | Rf1 + Rf3 + Rf7 | NCIMB 42814 |
| LGWR17-0096 | R204/R213//ARISTOTE | F6 | Rf1 + Rf3 + Rf7 | NCIMB 42815 |
| LGWR17-0154 | R204/R213//ARISTOTE | F6 | Rf1 + Rf3 + Rf7 | NCIMB 42816 |
| LGWR17-0157 | R204/R213//ARISTOTE///NIC07-5520 | HD | Rf1 + Rf3 + Rf7 | NCIMB 42817 |

Example 21: Test of the Cumulative Effect of Rf1, Rf3 and Rf7 Genes Outdoor

Fertility from 4 hybrids produced with the restorer lines LGWR17-0022, LGWR17-0153, LGWR17-0154 and LGWR17-0157 was assessed in field as described in example 19 for the fertility assessment of the main tillers. The restorer lines have the pedigree and haplotypes as described in table 23.

The assays are made with agronomically adapted hybrids in three different countries France, Germany and United Kingdom. In total 28 hybrids are tested and compared to 26 control Elite inbreds. The result show that, in the field, the hybrids comprising the combination of the three alleles Rf1, Rf3 and Rf7 restorers performed as well as the elite inbreds (table 24). It is also worth to be noted that, in this combination, the Rf3 weak or Rf3 do not have any impact on the fertility level.

TABLE 23 pedigree and haplotype of the restorer lines

| CODE | PEDIGREE | HAPLOTYPE Rf | NCIMB deposit |
|---|---|---|---|
| LGWR17-0022 | R204/R213//ARISTOTE///NIC07-5520 | Rf1 + Rf3 + Rf7 | yes |
| LGWR17-0153 | R204/R213//ARISTOTE | Rf1 + Rf3weak + Rf7 | no |
| LGWR17-0154 | R204/R213//ARISTOTE | Rf1 + Rf3weak + Rf7 | yes |
| LGWR17-0157 | R204/R213//ARISTOTE///NIC07-5520 | Rf1 + Rf3 + Rf7 | yes |

TABLE 24 fertility (expressed as number of seeds/spikelet) of a series of spikes from hybrids produced with the restorer lines LGWR17-0022, LGWR17-0153, LGWR17-0154 and LGWR17-0157 and from a panel of elite lines. Each spike originates from the tallest tiller. The standard deviation "STD. DEV." are given for each of the three groups.

| | | SPIKES | Fertility average | STD DEV. |
|---|---|---|---|---|
| Hybrids | Total | 169 | 2.71 | 0.47 |
| | Rf1 + Rf3weak + Rf7 | 43 | 2.72 | 0.38 |
| | Rf1 + Rf3 + Rf7 | 126 | 2.71 | 0.49 |
| Elite inbreds | | 226 | 2.73 | 0.43 |

Example 22: Modification of the Endogenous RFL29c Gene Sequence by CRISPR Technologies to Revert a Rf3 Allele to a Rf3 Allele As shown in example 11, FIG. 5A and FIG. 12, RFL29c nucleotide sequence is characterized by a deletion of 2 nucleotides compared to RFL29a nucleotide sequence creating a frameshift and resulting in an inactive truncated protein. The sequence alignment in FIG. 12 shows that one "T" nucleotide in the RFL29c gene sequence could be removed or 2 nucleotides added in order to reframe the RFL29c gene sequence into a complete and functional RFL29 protein.

Such modification could be achieved in Fielder, which comprises a RFL29c as depicted in SEQ ID NO 3457, by designing, as described in example 15, a suitable guide sequence targeting the frameshift and used it in combination with a base-editing technology such as described in WO2015089406. FIG. 12 shows suitable PAM motif and target sequence for CRISPR cas9 edition.

BIBLIOGRAPHY

Ahmed et al, 2001. QTL analysis of fertility restoration against cytoplasmic male sterility in wheat. Genes Genet Syst, 76:33-38.

Bahl P N, Maan S S, 1973. Chromosomal location of fertility restoring genes in six lines of common wheat. Crop Sci 13:317-320.

Bennetzen J L et al, 2012.Reference genome sequence of the model plant Setaria. Nat Biotechnol 30 (6): 555-+. doi: 10.1038/nbt.2196

Brenchley R, et al, 2012. Analysis of the bread wheat genome using whole-genome shotgun sequencing. Nature 491 (7426): 705-710. doi: 10.1038/nature11650

Cannarozzi G, et al, 2014. Genome and transcriptome sequencing identifies breeding targets in the orphan crop tef (Eragrostis tef). Bmc Genomics 15. doi: Artn 58110.1186/1471-2164-15-581

Chen J F et al, 2013. Whole-genome sequencing of Oryza brachyantha reveals mechanisms underlying Oryza genome evolution. Nature Communications 4. doi: ARTN 159510.1038/ncomms2596

Cheng S F, Gutmann B, Zhong X, Ye Y T, Fisher M F, Bai F Q, Castleden I, Song Y, Song B, Huang J Y, Liu X, Xu X, Lim B L, Bond C S, Yiu S M, Small I (2016) Redefining the structural motifs that determine RNA binding and RNA editing by pentatricopeptide repeat proteins in land plants. Plant Journal 85 (4): 532-547. doi: 10.1111/tpj.13121.

Christensen A H and Quail P H, 1996. Ubiquitin promoter-based vectors for high-level expression of selectable and/or screenable marker genes in monocotyledonous plants. Transgenic Res, May;5 (3): 213-8.

Christian et al, 1992. Maize polyubiquitin genes: structure, thermal perturbation of expression and transcript splicing, and promoter activity following transfer to protoplasts by electroporation. Plant Mol Biol. 18 (4): 675-89.

Curtis and Lukaszewski, 1993. Localization of genes in Rye that restore male fertility to hexaploid wheat with timopheevii cytoplasm. Plant breeding, 11:106-112.

Depigny-This D et al, 1992. The cruciferin gene family in radish. Plant Molecular Biology, 20:467-479.

Fehr W R et al, 1987. Principles of Cultivar Development Vol. 1 Theory and Technique. Macmillan, New York . . .

Fujii S, Bond C S, Small I D (2011) Selection patterns on restorer-like genes reveal a conflict between nuclear and mitochondrial genomes throughout angiosperm evolution. P Natl Acad Sci USA 108 (4): 1723-1728. doi: DOI 10.1073/pnas. 1007667108.

Geyer M et al, 2016. Distribution of the fertility-restoring gene Rf3 in common and spelt wheat determined by an informative SNP marker. Mol Breeding, 36:167. DOI 10.1007/s11032-016-0592-6.

Götz H et al, 2011.Transgene Expression Systems in the Triticeae Cereals. Journal of Plant Physiology 168, no. 1:30-44. doi: 10.1016/j.jplph.2010.07.007.

International Brachypodium I (2010) Genome sequencing and analysis of the model grass Brachypodium distachyon. Nature 463 (7282): 763-768. doi: 10.1038/nature08747

Jacquemin J, et al, 2013. The International *Oryza* Map Alignment Project: development of a genus-wide comparative genomics platform to help solve the 9 billion-people question. Curr Opin Plant Biol 16 (2): 147-156. doi: 10.1016/j.pbi.2013.02.014.

Jefferson, R. A., 1987. Assaying chimeric genes in plants: The GUS gene fusion system. Plant Mol. Biol. Report. 5, 387-405. DOI: 10.1007/BF02667740

Jia J, et al, 2013. *Aegilops tauschii* draft genome sequence reveals a gene repertoire for wheat adaptation. Nature 496 (7443): 91-95. doi: 10.1038/nature12028.

Jones H D, 2015. Wheat Biotechnology: Current Status and Future Prospects. K. Azhakanandam et al. (eds.), Recent Advancements in Gene Expression and Enabling Technologies in Crop Plants, DOI 10.1007/978-1-4939-2202-4_8.

Kay R, et al 1987. Duplication of CaMV 35S promoter sequences creates a strong enhancer for plant genes. Science 236:1299-1302.

Kawahara Y et al, 2013. Improvement of the *Oryza sativa* Nipponbare reference genome using next generation sequence and optical map data. Rice 6. doi: Artn 410.1186/1939-8433-6-4.

Kihara, 1951, Genome analysis in *Triticum* and *Aegilops* X. Concluding review. Cytologia, 16:101-123.

Kojima et al, 1997, High-resolution RFLP mapping of the fertility restoration (Rf3) gene against *Triticum timopheevii* cytoplasm located on chromosome 1BS of common wheat. Genes Genet Syst, 72:353-359.

Krasileva K V et al, 2013. Separating homeologs by phasing in the tetraploid wheat transcriptome. Genome Biol 14 (6). doi: ARTN R66 10.1186/gb-2013-14-6-r66.

Li et al, 2003. OrthoMCL: Identification of Ortholog Groups for Eukaryotic Genomes. Genome Res. 2003 September; 13 (9): 2178-2189.

Li H. and Durbin R, 2010. Fast and accurate long-read alignment with Burrows-Wheeler Transform. Bioinformatics, Epub. [PMID: 20080505]

Ling H Q et al, 2013. Draft genome of the wheat A-genome progenitor *Triticum urartu*. Nature 496 (7443): 87-90. doi: 10.1038/nature11997

Longin et al, 2012, Hybrid breeding in autogamous cereals. Theor Appl Genet.: 125:1007-1096. DOI 10.1007/s00122012-1967-7.

Ma Z Q and Sorrells M E, 1995, Genetic analysis of fertility restoration in wheat using RFLP. Crop Sci., 35:1137-1143.

Mace E S et al, 2013. Whole-genome sequencing reveals untapped genetic potential in Africa's indigenous cereal crop sorghum. Nat Commun 4:2320. doi: 10.1038/ncomms3320.

McElroy D et al, 1990. Isolation of an Efficient Actin Promoter for Use in Rice Transformation. The Plant Cell, Vol. 2, 163-171.

Martis M M et al, 2013. Reticulate Evolution of the Rye Genome. Plant Cell 25 (10): 3685-3698. doi: 10.1105/tpc.113.114553

Mayer K F X, et al, 2014. A chromosome-based draft sequence of the hexaploid bread wheat (*Triticum aestivum*) Science genome. 345 (6194). doi: ARTN 125178810.1126/science. 1251788

Mayer K F X et al, Conso IBGS, 2012. A physical, genetic and functional sequence assembly of the barley genome. Nature 491 (7426): 711-+. doi: 10.1038/nature 11543.

Ouyang S et al, 2007. The TIGR Rice Genome Annotation Resource: Improvements and new features. Nucleic Acids Res 35: D883-D887. doi: 10.1093/nar/gk1976.

Pallavi Sinha P et al 2013. Genetic analysis and molecular mapping of a new fertility restorer gene Rf8 for *Triticum timopheevii* cytoplasm in wheat (*Triticum aestivum* L.) using SSR markers. Genetica, 141:131-141.

Paterson A H et al, 2009. The *Sorghum bicolor* genome and the diversification of grasses. Nature 457 (7229): 551-556. doi: 10.1038/nature07723.

Rathburn and Hedgcoth, 1991. Chimeric open reading frame in the 5' flanking region of coxl mitochondrial DNA from cytoplasmic male-sterile wheat. Plant Mol. Biol., 16:909-912.

Rice P et al, 2000. A. EMBOSS: The European molecular biology open software suite. Trends Genet 16, 276-277, 10.1016/S0168-9525 (00) 02024-2.

Sakai H, et al, 2013. Rice Annotation Project Database (RAP-DB): An Integrative and Interactive Database for Rice Genomics. Plant Cell Physiol 54 (2): E6-+. doi: 10.1093/pcp/pcs183.

Schnable P S, et al, 2009. The B73 Maize Genome: Complexity, Diversity, and Dynamics. Science 326 (5956): 1112-1115. doi: 10.1126/science.1178534.

Singh S K et al, 2010. Perspective of hybrid wheat research: a review. Indian J Agric Sci 80:1013-1027.

Song and Hedgcoth, 1994. Influence of nuclear background on transcription of a chimeric gene orf256 and cox1 in fertile and cytoplasmic male sterile wheats. Genome, vol. 37

Stojalowski S et al, 2013. The importance of chromosomes from the sixth homeologic group in the restoration of male fertility in winter triticale with *Triticum tomopheevii* cytoplasm. J. Appl. Genetics, 54:179-184.

Verdaguer et al, 1996. Isolation and expression in transgenic tobacco and rice plants, of the cassava vein mosaic virus (CVMV) promoter. Plant Molecular Biology 31:1129-1139.

Wang M H et al, 2014. The genome sequence of African rice (*Oryza glaberrima*) and evidence for independent domestication. Nat Genet 46 (9): 982-+. doi: 10.1038/ng.3044Wilson J A, Ross W M. 1962. Male sterility interaction of the *Triticum aestivum* nucleus and *Triticum timopheevii* cytoplasm. Wheat Information Service (Kyoto) 14:29-30.

Wilson J A, Ross W M. 1962. Male sterility interaction of the *Triticum aestivum* nucleus and *Triticum timopheevii* cytoplasm. Wheat Information Service (Kyoto) 14, 29-30.

Wilson, 1984. Hybrid wheat breeding and commercial seed development. Plant Breeding Rev., 2:303-319. 2

Whitford R et al, 2013. Hybrid breeding in wheat: technologies to improve hybrid wheat seed production. Journal of Experimental Botany. doi: 10.1093/jxb/ert333.

Zhou et al, 2005. SSR marker associated with fertility restoration genes against *Triticum timopheevii* cytoplasm in *Triticum aestivum*. Euphytica, 141:33-40.

SEQUENCE LISTING (3479 sequences)

SEQ ID NO: 1 - protein, 983 aa, Triticum aestivum
MLTNIGILKKIIPFYGFCGAFSRACNKFIFLVDIKFYSYRLGDTNIHIIILLYLKRTHILSLYQNIGRLYTWKSTRLAPISRPTTTKAMPRFSSTTPMSPLRLRLRRRLRARHSSSTSHSSRSWEPHAAFAAATERARSGNLTPEDAHHLFDELLRQGNPVQDRPLNKLLSALARAPASAACRNGPALAVALFSRISQGARRRVAEPTACTYTILMDCCCRAHRLDLALAFFGRLLRTGLKTGVIEVNTLLKGLCHSKRADEAMEVLLHRMPELGCTPDVVACNTVIHGFFKEGQVGKACNLFHEMGQHGVTPDVVTYNSVIDGLCKARAMDKAEVVLHQMLVNGVVPDKVTYGSLIDGYYSLAHWKEAVRLFEEMKSQRVTPDVHTYNLCIHGFFREGQVGKACNLFHEMGQQGVTPDVVTYNSVIDALCKARAMDKAEYFLRQMVDSGVVPNNVTYNSLIHGYSSSGYQKEAVRVLKEMTSQGIIPDVFTFNSLMASLSKNGRSKEAAEIFDSMAMKGLKPDIVSYNTLLHGYATEGCLVGMTNFFNSMTRDGIRPNCHTLNILINAYAKSGMMDEAMVIFKGMRKQGVSPDVVTYSTVIHGFCKIGRLDNAMVKFKQMTDMGVRPNPIVYHSLIQGFCTHGDLVKAKELVTEMRYKGMRPPDIKVFHLAMQNLCTEGRVTKARDILDLIVHIGMRPDVFTFSLLIGGYCLVCKMEDASKIFDDMVSYGLEPSNITYGILINGYCKNKRIDDGLILFKTMLHKGLKPTTFNYNVILDGLFLAGRTVAAKEKFNEMVESGVSVCIDTCSIVLGGLCKNSCSSEAITLFRKLSTMNVKFDINIVNIIIGAFYSVKRNQEAKDLFAAIPANGLVPNAVTYTIMMTNLIKEGSVEEADNLFLSMEKSGCTANSWMLNHIIRRLLERGEIVKAGNYMSKVDVKSYSLEAKTVSLLISLFSREGKYRDHIKLLPTKYQFLEEAATVE

SEQ ID NO: 2 - protein, 440 aa, Triticum aestivum
MTNLFNSMTRDGIRPNCHTLNILINAYAKSGMMDEAMLIFKGMRKQGVSPNVVTYSTVIHGFCKIGKLDNAMVKFKQMTDMGVRPNPIVYHSLIQGFCTHGDLVKAKELVTEMRYKGMRPPDIKVFHLAMQNLCTEGRVTKARDILDLIVHIGMRPDVFTFSILIGGYCLVCKMEDASKIFDDMVSYGLEPSNITYGILINGYCKNKRIDDGLILFKTMLHKGLKPTTFNYNVILDGLFLAGRTVAAKEKFNEMVESGVSVCIDTCSIVLGGLCKNSCSSEAITLFRKLSTMNVKFDINIVNIIIGAFYRVKRNQEAKDLFAAIPANGLVPNAVTYTIMMTNLIKEGSVEEADNLFLSMEKSGCTANSWMLNHIIRRLLERGEIVKAGNYMSKVDVKSYSLEAKTVSLLISLFSREGKYRDHIKLLPTKFQFLEEAATVE

SEQ ID NO: 3 - protein, 917 aa, Triticum aestivum
MRSCFCNRAFIAGCNEWACGAWTLHRTAISSCIQRSSRRRSKHRPGDLLQVTRTTILGRRREYVFVIKKKRVVYLHKQSNTGSSSKRLTSPVPSRLPRRSPMSSLHLLRHRSSSFTPTSPPSPSWSPHAAFTAATERVRAGTLSPEDAHHLFDQLLQQSTPVPEQALNGFLAALTRARAPDTEVCRDGPSLALTLFNRVWREEAGRRVALPTVRTYNILMNCCCRVRRPDLGLAYFGRLLRTSLKTNEVVANTVLMCLCCAKRTDEAVNVLLHRMSVLGCVPDEFSYNIVLKSLCKEGRSQQALNLLHVMAKGDGCSPDVVAYNTVIYGFFKEGEVGKACNLFHEMMRQGVVPDVVTYSSIIDALCKAGAMDKAELFLRQMVDNSVQPDTVTYTSMIHGYSTLGRWKEATKMLREMTSRGLIPNIVTWNSFMASLCKHGKSKEAAEIFFSMAARGHKPDIVSYTTLLHGYANEGSFADMMKLFNSMVGNGIVANCQVFNILIDAYAQRGMMDEAMLIFTEMPGQGVNPNVVTYSIVIAALCRMGRLADAMNKFSEMIGTGVQPNIVVYHSLVQGLCTHGDLVKAKVLISEMMNKGIARPNIAFFSSIMGSLCNEGRIMNAHDIFDLVTDIGVKPDVITFNMLMVGYCLVGEMEKAFKVLDAMVSVGIEPDVVTYSSLISGYCKTGRLDDGVTLFREMLHKRIKPDTVSYNTILDGLFNAGRTAAARKMFHEMIESGVMVSISTYNIILGGLCRNNCMDEAIVLFRKLRAVNVKFNITTLNTIINALYNVQRREEAHDLFAALPASRLVPNASTYRVMIDNLLKEGAVEEADSMFSSMEKSGCAPSSHFLNYIIRMLLEKGEIVKAGKYMSKVDGKIILLEASTTSLLMSLFSRGGKYQEHILLLPAKYHFFSGVNHS

SEQ ID NO: 4 - protein, 816 aa, Triticum aestivum
MSSLHLLRHRSSSFTPTSPPSPSWSPHAAFTAATERVRAGTLSPEDAHHLFDQLLQQSTPVPEQALNGFLAALTRARAPDTDVCRDGPSLALTLFNRVWREEAGRRVALPTVRTYNILMNCCCRVRRPDLGLAYFGRLLRTSLKTNEVVANTVLMCLCCAKRTDEAVNVLLHRMSVLGCVPDEFSYNIVLKSLCKEGRSQQALNLLHVMAKGDGCSPDVVAYNTVIYGFFKEGEVGKACNLFHEMMRQGVVPDVVTYSSIIDALCKAGAMDKAELFLRQMVDNSVQPDTVTYTSMIHGYSTLGRWKEATKMLREMTSRGLIPNIVTWNSFMASLCKHGKSKEAAEIFFSMAARGHKPDIVSYTTLLHGYANEGSFADMMKLFNSMVGNGIVANCQVFNILIDAYAQRGMMDEAMLIFTEMPGQGVNPNVVTYSIVIASLCRMGRLADAMNKFSEMIGTGVQPNIVVYHSLVQGLCTHGDLVKAKVLISEMMNKGITRPNIAFFSSIMGSLCNEGRIMNAHDIFDLVTDIGVKPDVITFNMLMVGYCLVGEMEKAFKVLDAMVSVGIEPDVVTYSSLISGYCKTGRLDDGVTLFREMLHKRIKPDTVSYNTILDGLFNAGRTAAAKKMFHEMIESGVMVSISTYNIILGGLCRNNCMDEAIVLFRKLRAVNVKFNITTLNTIINALYNVQRREEAHDLFAALPASRLVPNASTYRVMIDNLLKEGAVEEADSMFSSMEKSGCAPSSHFLNYIIRMLLEKGEIVKAGKYMSKVDGKIILLEASTTSLLMSLFSRGGKYQEHILLLPAKYHFFSGVNHS

SEQ ID NO: 5 - protein, 968 aa, Triticum aestivum
MAAAPRGLQLCRSRGQEYVVSVTERLLREITSGHAVLFSATERLLREVRVGMRSCFCNRAFIAGCNEWACGAWTLHRTAISSCIQRSSRRRSKHRPGDLLQVTRTTILGRRREYVFVIKKKRVVYLHKQSNTGSSSKRLTSPVPSRLPRRSPMSSLHLLRHRSSSFTPTSPPSPSWSPHAAFTAATERVRAGTLSPEDAHHLFDQLLQQSTPVPEQALNGFLAALTRARAPDTEVCRDGPSLALTLFNRVWREEAGRRVALPTVRTYNILMNCCCRVRRPDLGLAYFGRLLRTSLKTNEVVANTVLMCLCCAKRTDEAVNVLLHRMSVLGCVPDEFSYNIVLKSLCKEGRSQQALNLLHVMAKGDGCSPDVVAYNTVIYGFFKEGEVGKACNLFHEMMRQGVVPDVVTYSSIIDALCKAGAMDKAELFLRQMVDNSVQPDTVTYTSMIHGYSTLGRWKEATKMLREMTSRGLIPNIVTWNSFMASLCKHGKSKEAAEIFFSMAARGHKPDIVSYTTLLHGYANEGSFADMMKLFNSMVGNGIVANCQVFNILIDAYAQRGMMDEAMLIFTEMPGQGVNPNVVTYSIVIAALCRMGRLADAMNKFSEMIGTGVQPNIVVYHSLVQGLCTHGDLVKAKVLISEMMNKGIARPNIAFFSSIMGSLCNEGRIMNAHDIFDLVTDIGVKPDVITFNMLMVGYCLVGEMEKAFKVLDAMVSVGIEPDVVTYSSLISGYCKTGRLDDGVTLFREMLHKRIKPDTVSYNTILDGLFNAGRTAAARKMFHEMIESGVMVSISTYNIILGGLCRNNCMDEAIVLFRKLRAVNVKFNITTLNTIINALYNVQRREEAHDLFAALPASRLVPNASTYRVMIDNLLKEGAVEEADSMFSSMEKSGCAPSSHFLNYIIRMLLEKGEIVKAGKYMSKVDGKIILLEASTTSLLMSLFSRGGKYQEHILLLPAKYHFFSGVNHS

SEQ ID NO: 6 - protein, 917 aa, Triticum aestivum
MRSCFCNRAFIAGCNEWACGAWTLHRTAISSGIQRSSRRRYKHQPGDLLQVTRTTILGRRREYVFVIKKKRVVYLHKQSNTGSSSKRLTSPVPSRLPRRSPMSSLHLLRHRSSSFTPTSPPSPSWSPHAAFTAATERVRAGTLSPEDAHHLFDQLLQQSTPVPEQALNGFLAALTRARAPDTDVCRDGPSLALTLFNRVWREEAGRRVALPTVRTYNILMNCCCRVRRPDLGLAYFGRLLRTSLKTNEVVANTVLMCLCCAKRTDEAVNVLLHRMSVLGCVPDEFSYNIVLKSLCKEGRSQQALNLLHVMAKGDGCSPDVVAYNTVIYGFFKEGEVGKACNLFHEMMRQGVVPDVVTYSSIIDALCKAGAMDKAELFLRQMVDNSVQPDTVTYTSMIHGYSTLGRWKEATKMLREMTSRGLIPNIVTWNSFMASLCKHGKSKEAAEIFFSMAARGHKPDIVSYTTLLHGYANEGSFADMMKLFNSMVGNGIVANCQVFNILIDAYAQRGMMDEAMLIFTEMPGQGVNPNVVTYSIVIASLCRMGRLADAMNKFSEMIGTGVQPNIVVYHSLVQGLCTHGDLVKAKVLISEMMNKGITRPNIAFFSSIMGSLCNEGRIMNAHDIFDLVTDIGVKPDVITFNMLMVGYCLVGEMEKAFKVLDAMVSVGIEPDVVTYSSLISGYCKTGRLDDGVTLFREMLHKRIKPDTVSYNTILDGLFNAGRTAAAKKMFHEMIESGVMVSISTYNIILGGLCRNNCMDEAIVLFRKLRAVNVKFNITTLNTIINALYNVQRREEAHDLFAALPASRLVPNASTYRVMIDNLLKEGAVEEADSMFSSMEKSGCAPSSHFLNYIIRMLLEKGEIVKAGKYMSKVDGKIILLEASTTSLLMSLFSRGGKYQEHILLLPAKYHFFSGVNHS

SEQ ID NO: 7 - protein, 917 aa, Triticum aestivum; identical to SEQ ID NO: 6

SEQ ID NO: 8 - protein, 917 aa, Triticum aestivum; identical to SEQ ID NO: 3

SEQ ID NO: 9 - protein, 504 aa, Triticum aestivum
MLRKMTTRGLIPDIVTCSSLMTSLCKHGRSKEALDIFCSMTAKGLKPNIIAYSILLHGYATEGCFVDMINLFNSMEDNGIAANCYVFNILIDAYAKHGMMDEAMLIFTEMREKGVSPDVVTYSTVITAFCRLRRLADAMDKFNEMTDMGVQPDTTVYHSLIQGFCMHGDLVKAKGLVSEMTNKGIPRPDIVFFSSIINTLCKEGRVMDAQDIFEMVISIDGRPDVITFSSLIDGYGLVGQMGKALGVLDAMVSAGIEPDVVTYSSLLDGYCRNGRINDALILFREMPHKRIKPNTVTYGIILDGLFRAGRTVDARKMFHEMIERGITVSISIYNIILGGLCRNNCADEAIALFQKLGAMNVKFNIITLNTMINAMFKVRRREEANDLFAAISAGGLVPNASTYGIMIKNILKEGSVEEVDSMFSSMEKSGIIPNSCLINIIIRMLLEKGEIAKARNYLSKVDGKVISLEASTTSLLLSLFSRKGKYRESIELLPANYQFFDGFG

SEQ ID NO: 10 - protein, 697 aa, Triticum aestivum
MGCFCGARRPDLGLALFGHFLRTGLKTNKIVATTFLKCLCCAKRTDEAVNVLLHRMPELGCVPDAFSYSIVLKSLCENSMSQRALDLLQMVAKGGDACSVNVVAYNTVIHGFFKEGETGKACNLFHEMIHQGVVPDVVTFNSIIHALCKARAMDKAEIVLRQMVDNGAQPNEVTYNCMIHGYSKSGQLREGTKMLRKMTTRGLIPDIVTCSSLMTSLCKHGRSKEALDIFCSMTAKGLKPNIIAYSILLHGYATEGCFVDMINLFNSMEDNGIAANCYVFNILIDAYAKHGMMGEAMLIFTEMREKGVSPDVVTYSTVIAAFCRLRRLADAMDKFNEMTDMGVQPDTTVYHSLIQGFCMHGDLVKAKGLVSEMTNKGIPRPDIAFFSSIINTLCKEGRVMDAQDIFEMVISIDGRPDVITFSSLIDGYGLVGQMGKALGVLDAMVSAGIEPDVVTYSSLLDGYCRNGRINDALILFREMPRKRIKPNTVTYGIILDGLFRAGRTVDARKMFHEMIERGITVSISICNIILGGLCRNNCADEAIALFQKLGAMNVKFNIITLNAMINAMFKVRRREEANDLFAAISASGLVPNASTYGIMIKNILKEGSVEEVDSMFSSMEKSGIIPNSCLINIIIRMLLEKGEIAKAGNYLSKVDGKVISLEASTTSLLLSLFSRKGKYRESIELLPANYQFFDGFG

SEQ ID NO: 11 - protein, 1394 aa, Triticum aestivum
MGCFCGARRPDLGLALFGHFLRTGLKTNKIVATTFLKCLCCAKRTDEAVNVLLHRMPELGCVPDAFSYSIVLKSLCENSMSQRALDLLQMVAKGGDACSVNVVAYNTVIHGFFKEGETGKACNLFHEMIHQGVVPDVVTFNSIIHALCKARAMDKAEIVLRQMVDNGAQPNEVTYNCMIHGYSKSGQLREGTKMLRKMTTRGLIPDIVTCSSLMTSLCKHGRSKEALDIFCSMTAKGLKPNIIAYSILLHGYATEGCFVDMINLFNSMEDNGIAANCYVFNILIDAYAKHGMMGEAMLIFTEMREKGVSPDVVTYSTVIAAFCRLRRLADAMDKFNEMTDMGVQPDTTVYHSLIQGFCMHGDLVKAKGLVSEMTNKGIPRPDIAFFSSIINTLCKEGRVMDAQDIFEMVISIDGRPDVITFSSLIDGYGLVGQMGKALGVLDAMVSAGIEPDVVTYSSLLDGYCRNGRINDALILFREMPRKRIKPNTVTYGIILDGLFRAGRTVDARKMFHEMIERGITVSISICNIILGGLCRNNCADEAIALFQKLGAMNVKFNIITLNAMINAMFKVRRREEANDLFAAISASGLVPNASTYGIMIKNILKEGSVEEVDSMFSSMEKSGIIPNSCLINIIIRMLLEKGEIAKAGNYLSKVDGKVISLEASTTSLLLSLFSRKGKYRESIELLPANYQFFDGFGMGCFCGARRPDLGLALFGHFLRTGLKTNKIVATTFLKCLCCAKRTDEAVNVLLHRMPELGCVPDAFSYSIVLKSLCENSMSQRALDLLQMVAKGGDACSVNVVAYNTVIHGFFKEGETGKACNLFHEMIHQGVVPDVVTFNSIIHALCKARAMDKAEIVLRQMVDNGAQPNEVTYNCMIHGYSKSGQLREGTKMLRKMTTRGLIPDIVTCSSLMTSLCKHGRSKEALDIFCSMTAKGLKPNIIAYSILLHGYATEGCFVDMINLFNSMEDNGIAANCYVFNILIDAYAKHGMMGEAMLIFTEMREKGVSPDVVTYSTVIAAFCRLRRLADAMDKFNEMTDMGVQPDTTVYHSLIQGFCMHGDLVKAKGLVSEMTNKGIPRPDIAFFSSIINTLCKEGRVMDAQDIFEMVISIDGRPDVITFSSLIDGYGLVGQMGKALGVLDAMVSAGIEPDVVTYSSLLDGYCRNGRINDALILFREMPRKRIKPNTVTYGIILDGLFRAGRTVDARKMFHEMIERGITVSISICNIILGGLCRNNCADEAIALFQKLGAMNVKFNIITLNAMINAMFKVRRREEANDLFAAISASGLVPNASTYGIMIKNILKEGSVEEVDSMFSSMEKSGIIPNSCLINIIIRMLLEKGEIAKAGNYLSKVDGKVISLEASTTSLLLSLFSRKGKYRESIELLPANYQFFDGFG

SEQ ID NO: 12 - protein, 504 aa, Triticum aestivum; identical to SEQ ID NO: 9

SEQ ID NO: 13 - protein, 697 aa, Triticum aestivum; identical to SEQ ID NO: 10

SEQ ID NO: 14 - protein, 697 aa, Triticum aestivum; identical to SEQ ID NO: 10

SEQ ID NO: 15 - protein, 813 aa, Triticum aestivum
MSGVCLRRRLSSTSTSNTPPSPSWSPQAAFAAATERARAGTLSPQDAHHLFDELFRQATPVPERSLEGFLAALGRAASSEACRDGPSLALTLFNRLCREEAGRRVAPPTIYTYGILMNCCCRVRRPDLGLAFFGRLLRTGLKTNEVVASTLLKCLCCAKRADEAVNVLLHRMSVLGCVPNSFSYNIVLKSLCDDSRSQRALGLLQMMAKGGVCSPNVLSYNTVIHGFFKEGEIDKACNLFHEMTKQGFVPNVVTYNSVINALCKARAMDNAESFLRQMVDNGVPPDKVTYTSIIHGYSTLGRWKEATKMFREMTSRGLIPDIVTRNSFMDSLCKHGRSKEAAEIFFSMAARGHKPDIVSYTILLHGYGNEGSFSDMMSLFNSMEGGGIVADCQVFNILIDAYAKRGMIDEAMLIFTEMLGQGVNPSVVTYSTLIAALCRTGRLADAMDKFSQMVGTGVQPDTVVYHSLIQGFCTHGDLVKAKELISEMMNKGIICPNIAFFNSIVDSLCKEGRVMDAHHIFDLVKDIGEKPDAIMFNTLIDGYCLVGEMGKAFMVLDVMTSAGIEPDAITYSTLVSGYCKSGRIDDGLILFREEMLHKKVKPTIVTYNIILEGLFRAGRTVAAKKMLHEIIGSGTPVSMHTYDIFLRGLCRNNCADEAIVLFQKSRAMNVKFNITTLNTMINAFYKGDRREEANDLFAALPASGLVPNASTYGVMIQNLLKEGAVEEADNMFSSMEKSGCAPSSRLVNDVIRTLLEKGEIVKAGKYMSKVYGKSLSLDASTSSLLLSLFSGNGKYREQIQLLPAKYQFFGGIS

SEQ ID NO: 16 - protein, 813 aa, Triticum aestivum; identical to SEQ ID NO: 15

SEQ ID NO: 17 - protein, 813 aa, Triticum aestivum; identical to SEQ ID NO: 15

SEQ ID NO: 18 - protein, 813 aa, Triticum aestivum; identical to SEQ ID NO: 15

SEQ ID NO: 19 - protein, 813 aa, Triticum aestivum; identical to SEQ ID NO: 15

SEQ ID NO: 20 - protein, 813 aa, Triticum aestivum; identical to SEQ ID NO: 15

SEQ ID NO: 21 - protein, 608 aa, Triticum aestivum
MMAKGGVCSPNVLSYNTVIHGFFKEGEIGKACNLFHEMAKQGFVPNVVTYNSVINALCKARAMDNAESFLRQMVDNGVPPDKVTYTSIIHGYSTLGRWKEATKMFRETTSRGHIPDIVTRNSFMDSLCKHGRSKEAAEIFFSMAARGHKPDIVSCTILLHGYGNEGSFSDMMSLFNSMEGGGIVADCQVFNILIAAYAKRGMIDEAMLIFTEMLGQGVNPSVVTYSTLIAALCRTGRLADAMDKFSQMVDTGVQPDTVVYHSLIQGFCTHGDLVKAKELISEMMNKGMICPNIAFFNSIVDSLCKEGRVMDAHHIFDLVKDIGEKPDVIMFNTLIDGYCLVGEMGKAFMVLDVMTSAGIEPDAITYSTLVSGYCKSGRIDDGLILFREEMLHKKVKPTIVTYNIILEGLFRAGRTVAAKKMLHEIIGSGTPVSMHTYDIFLRGLCRNNCANEAIVLFQKSRAMNVKFNITTLNTMINAFYKGDRREEANDLFAALPASGLVPNASTYGVMIQILLKEGAVEEADNMFSSMEKSGCAPSSRLVNDVIRTLLEKGEIVKAGKYMSKVDGKSISLDASTSSLLLSLFSGNGKYREQIQLLPAKYQFFGGIS

SEQ ID NO: 22 - protein, 880 aa, Triticum aestivum
MLRRIRISTPVIGGKKAPVRTPDADAPRHPHPPPSPPLPLLHLAGVRSPPPSPPLVRLHQYRTTSTPMSRIHLHLHQHRRLFSSTSPPSRSWSPHEAFAAATERVRAGNFSWEDAHNLFDELLRQATPVPGRSLNGFLAALARAPASEACRDGPALALALFNHVCRDESGARVAPPTIFTYGILMNCCCRAHRPDLGLAFFGRLLRTGLKADLIVANTLLKCLCRAKRTDEAVNVLLHRMSELGCVPDAFSYSIVLKSLCDNGMSQQALNLLHMMAKVGGGCSPDVVAYSTVIHGFFKEGETGKACNLFHEMMQQGVEPNVWTYSSIIDALCKARAMDKAELVLQQMVNKGVQPDNVTYNCMIHGYSTSGRWKEAVKLFREMKSRGLIPDNFTCNSLMTYLCKHGRSKEGAEFFDAMTAKGHRDVISYYILLHGYANEGCFADMIDLFNSMERNGIAANCRVFNILINGHAKRGMTDEAMLIFTEMWEKGVSPNVVTYSTVIAALSRMGRLTDSMEKFNQMIAMGIQPNTAVYHSLIQGCFMHGGLVKAKELMFEMMNKGIPRPNIVFFSSVINSLCKEGRVMDAHAVFDLAIGIGERPNVITFNSLIDGYCLVGKMDKAFKILHVMESVGVESDVVTYSALLDGYFKNRRIDDALTLFREMPRKRIKPNTVTYGIMLGGLFHAGRTVAAMKMFHEMIESGATVRISTYNIILGGLCQTNCVDEAIALFQKLRAMNVKFNIEIFNTMIDAMYKVQRKEEAKELFAAISGNGLVPNEYTYAVMIRNLLKGGAVEDADNMFSSMDNSGIVPSSRLINDIIRMLLEKGEIAKAGNYLSKVDGKSISLEASTTSLMLSLFSRKGKHLEDIKLLPAKYQFFDGFG

SEQ ID NO: 23 - protein, 880 aa, Triticum aestivum
MLRRIRISTPVIGGKKAPVRTPDADAPRHPHPPPSPPLPLLHLAGVRSPPPSPPLVRLHQYRTTSTPMSRIHLHLHQHRRLFSSTSPPSRSWSPHEAFAAATERVRAGNFSWEDAHNLFDELLRQATPVPGRSLNGFLAALARAPASEACRDGPALALALFNHVCRDESGARVAPPTIFTYGILMNCCCRAHRPDLGLAFFGRLLRTGLKADLIVANTLLKCLCRAKRTDEAVNVLLHRMSELGCVPDAFSYSIVLKSLCDNGMSQQALNLLHMMAKVGGGCSPDVVAYSTVIHGFFKEGETGKACNLFHEMMQQGVEPNVWTYSSIIDALCKARAMDKAELVLQQMVNKGVQPDNVTYNCMIHGYSTSGRWKEAVKLFREMKSRGLIPDNFTCNSLMTYLCKHGRSKEGAEFFDAMTAKGHRDVISYYILLHGYANEECFADMIDLFNSMERNGIAANCRVFNILINGYAKRGMTDEAMLIFTEMWEKGVSPNVVTYSTVIAALSRMGRLTDSMEKFNQMIAMGIQPNTAVYHSLIQGCFMHGGLVKAKELMFEMMNKGIPRPNIVFFSSVINSLCKEGRVMDAHAVFDLAIGIGERPNVITFNSLIDGYCLVGKMDKAFKILHVMESVGVESDVVTYSALLDGYFKNRRIDDALTLFREMPRKRIKPNTVTYGIMLGGLFHAGRTVAAMKMFHEMIESGATVRISTYNIILGGLCQTNCVDEAIALFQKLRAMNVKFNIEIFNTMIDAMYKVQRKEEAKELFAAISGNGLVPNEYTYAVMIRNLLKGGAVEDADNMFSSMDNSGIVPSSRLINDIIRMLLEKGEIAKAGNYLSKVDGKSISLEASTTSLMLSLFSRKGKHLEDIKLLPAKYQFFDGFG

SEQ ID NO: 24 - protein, 880 aa, Triticum aestivum; identical to SEQ ID NO: 23

SEQ ID NO: 25 - protein, 880 aa, Triticum aestivum; identical to SEQ ID NO: 23

SEQ ID NO: 26 - protein, 880 aa, Triticum aestivum; identical to SEQ ID NO: 23

SEQ ID NO: 27 - protein, 880 aa, Triticum aestivum; identical to SEQ ID NO: 22

SEQ ID NO: 28 - protein, 877 aa, Triticum aestivum
MLRRIRISTPVAPVRTPDADAPRHPHPPPLPPLPLLHLAGVRSPPPSPPLVRLHQYRTTSTPMSRIHLHLHLHQHRRLFSSTSPPSRSWSPHEAFAAATERVRAGNFSWEDAHNLFDELLRQATPVPGRSLNGFLAALARAPASEACRDGPALALALFNHVCRDESGARVAPPTIFTYGILMNCCCRAHRPDLGLAFFGRLLRTGLKADLIVANTLLKCLCRAKRTDEAVNVLLHRMSELGCVPNAFSYSIVLKSLCDNGMSQQALDLLHMMAKEGGDCSPDVVAYSTVIHGFFKEGETGKACNLFHEMMQQGVEPNVWTYSSIIDALCKARAMDKAELVLQQMVNKGVQPDNVTYNCMIHGYSTSGRWKEAVKLFREMKSRGLIPDNFTCNSLMTYLCKHGRSKEGAEFFDAMTAKGHRDVISYCILLHGYANEGCFADMIDLFNSMERNGIAANCRVFNILINGYAKRGMTEEAMLIFTEMWEKGVSPNVVTYSTVIAALSRMGRLTDSMDKFNQMIAMGIQPNTAVYHSLIQGCFMHGGLVKAKELMFEMMNKGIPRPNIVFFSSVINSLCKEGRVMDAHAVFDLAIGIGERPNVITFNSLIDGYCLVGKMDKAFKILLVMESVGVEPDVVTYSALLDGYFKNRSIDDALTFFREMPRKRIKPNTVTYGIMLGGLFRAGRTVAAMKMFHEMIESGATVRISTYNIILGGLCQTNCVDEAIALFQKLRAMNVKFNIEIFNTMIDAMYKVQRKEEAKELFAAISGNGLVPNEYTYAVMIRNLLKGGAVEDADNMFSSMDNSGIVPSSRLINDIIRMLLEKGEIAKAGNYLSKVDGKSISLEASTTSLMLSLFSRKGKHLEDIKLLPAKYQFFDGFG

SEQ ID NO: 29 - protein, 367 aa, Triticum aestivum
MAAKGLKPNIVSYSTMLNGYVKEGSFEDMTDLFNSMVRNGIVPNHHIFNIQINAYAKRGLMDEAMHMFEVMRQQGVNPNVVDYLVVMNSLCKMGRMDAALDKFNQMVNQGVSPNKAVYQCLVLGSCSHGHFVKAKELISEAVNRGLCSNSVFFYPVINDLCKEGKVEGKVKEAQDMFDFIVGIGHRPDVIMYTSLMDGYCLVGKVEEALRVLDAMKSAGLQPDAFTYGILINGYCKIGRIDEGLSLVREISLSGVKPTTIMYNIILDGLFCSGRTVPAKEKFHKMNESAIPVGVGTYNIVLSGLCKNNCTDEAIELFKKLRAVNVKINVITLTTMISAMFSQKNGSTLALHLLSSFCHLILFAQLNI

SEQ ID NO: 30 - protein, 367 aa, Triticum aestivum; identical to SEQ ID NO: 29

SEQ ID NO: 31 - protein, 367 aa, Triticum aestivum
MAAKGLKPNIVSYSTMLNGYVKEGSFEDMTDLFNSMVRNGIVPNHHIFNIQINAYAERGLMDEAMHMFEVMRQQGVNPNVVDYLVVMNSLCKMGRMDAALDKFNQMVNQGVSPNKAVYQCLVLGSCSHGHFVKAKELISEAVNRGLCSNSVFFYPVINDLCKEGKVEGKVKEAQDMFDFIVGIGHRPDVIMYTSLMDGYCLVGKVEEALRVLDAMKSAGLQPDAFTYGILINGYCKIGRIDEGLSLVREISLSGVKPTTIMYNIILDGLFCSGRTVPAKEKFHKMNESAIPVGVGTYNIVLSGLCKNNCTDEAIELFKKLRAVNVKINVITLTTMISAMFSQKNGSTLALHLLSSFCHLILFAQLNI

SEQ ID NO: 32 - protein, 217 aa, Triticum aestivum
MRWSPTLCTYSILMYCCCRAGRPDLVVAFFGRILRLGLRLDVISLNNLLKGLCQAKRSNEALDLLLHRMPELHCAPDVFSYNIVINGCLKEGEVDKACNLFHEMPQLGVQPDVVTYTSIMDALSKSGAMDKAEVLLRQMVDQGIEPNIRTYSCLIHGYSTFGQWKEALRVFKEMATLGVVPDVVTLSSLIDSLCKHRRTKEAREIFDSIYGCKGPET

SEQ ID NO: 33 - protein, 773 aa, Triticum aestivum
MSTARLSSTFTSSFKAPSRKPRAPRLAALAAATERVRAGTLSRQDAHHLFDELLSQAATVPVRTLNNFLAALARAPPSAACGDGPALAVTLFNRMSRGAGARVVSPTLCTYSILMDCCCRAGRPDLVVAFFGRLLRLGLRLEVISFSNLLKGLCQAKRTNEAVDLLLHRTPELDCVPNVFSYSIVINGCFKEGEVDKACNLFHGMIQLGVQPNVVIYTSIIDALSKCGAMDKAEVVFRQMVDKGIGPDVMTCTSLIHGYSISGRWKAAVRVFKEMISLGVVPDTVMWNSFVDSLCKHRRTKEARVIFDSMAAKGQKPDTVSYSIMLNGYVKEGCFDDMTGLFNSMLQNGVVPNHHIFNILINAYAKRGLMDEAMHMFEVMRQQGVNPDVVDYLVVMDSLCKMGRMDAALDKFNQMVNQGVSPNKAVYQCLVLGFCSHGDFVKAKELISETINRGLCSNNVFFYPVINDLCKEGKVKEAQDMFDFIVGIGQRPDVIMYNSLMDGYCLVGKVEEALRVLDAMKSAGLQPDAITYAILLNGYCKIGRIADGLSLFREMSLSGVKPTTIMYSIILDGLFRSGRTVSAKEKFNTMVESGLPVDVRTYNIVLHGLCRNNCTGEAIELFKKLCATNLKINVITFNTMISAMFKTRRIGEAKDLFATISAIGLVPSVVTYSVMTTNFIKEGLLAEADDMFLAMEKAGCAPDSRLLNHVVSVLLENGAVVKAATYLAKLDAKQLSLEASTVSLIVSLFSRKGKLREHVKLLPVKYQPPEMLG

SEQ ID NO: 34 - protein, 773 aa, Triticum aestivum
MSTARLSSTFTSSFKAPSRKPRAPRLAALAAATERVRAGTLSRQDAHHLFDELLSQAATVPVRTLNNFLAALARAPPSAACGDGPALAVTLFNRMSRGAGARVVSPTLCTYSILMDCCCRAGRPDLVVAFFGRLLRLGLRLEVISFSNLLKGLCQAKRTNEAVDLLLHRTPELDCVPNVFSYSIVINGCFKEGEVDKACNLFHGMIQLGVQPNVVIYTSIIDALSKCGAMDKAEVVFRQMVDKGIGPDVMTCTSLIHGYSISGRWKAAVRVFKEMISLGVVPDTVMWNSFVDSLCKHRRTKEARVIFDSMAAKGQKPDTVSYSIMLNGYVKEGCFDDMTGLFNSMLQNGVVPNHHIFNILINAYAKRGLMDEAMHMFEVMRQQGVNPDVVDYLVVMDSLCKMGRMDAALDKFNQMVNQGVSPNKAVYQCLVLGFCSHGDFVKAKELISETINRGLCSNNVFFYPVINDLCKEGKVKEAQDMFDFIVGIGQRPDVIMYNSLMDGYCLVGKVEEALRVLDAMKSAGLQPDAITYAILLNGYCKIGRIADGLSLFREMSLSGVKPTTIMYSIILDGLFRSGRTVSAKEKFNTMVESGLPVDVRTYNIVLHGLCRNNCTGEAIELFKKLCATNVKINVITFNTMISAMFKTRRIGEAKDLFATISAIGLVPSVVTYSVMTTNFIKEGLLAEADDMFLAMEKAGCAPNSRLLNHVVRVLLENGAVVKAATYLAKLDAKQLSLEASTVSLIVSLFSRKGKLREHVKLLPVKYQPPEMLD

SEQ ID NO: 35 - protein, 539 aa, Triticum aestivum
MSTARLSSTFTSSFKAPSRKPRAPRLAALAAATERVRAGTLSRQDAHHLFDELLSQAATVPVRTLNNFLAALARAPPSAACGDGPALAVTLFNRMSRGAGARVVSPTLCTYSILMDCCCRAGRPDLVVAFFGRLLRLGLRLEVISFSNLLKGLCQAKRTNEAVDLLLHRTPELDCVPNVFSYSIVINGCFKEGEVDKACNLFHGMIQLGVQPNVVIYTSIIDALSKCGAMDKAEVVFRQMVDKGIGPDVMTCTSLIHGYSISGRWKAAVRVFKEMISLGVVPDTVMWNSFVDSLCKHRRTKEARVIFDSMAAKGQKPDTVSYSIMLNGYVKEGCFDDMTGLFNSMLQNGVVPNHHIFNILINAYAKRGLMDEAMHMFEVMRQQGVNPDVVDYLVVMDSLCKMGRMDAALDKFNQMVNQGVSPNKAVYQCLVLGSCSHGDFVKAKELISEALNRGLCSNSVFFYPVINDLCKEGKVKEAQDMFDFIVGIGQRPDVIMYNSLMDGYCLVGKVEEALRVLDAMKSAGLQPDAIMYGILLNDH

SEQ ID NO: 36 - protein, 773 aa, Triticum aestivum; identical to SEQ ID NO: 33

SEQ ID NO: 37 - protein, 773 aa, Triticum aestivum; identical to SEQ ID NO: 34

SEQ ID NO: 38 - protein, 773 aa, Triticum aestivum; identical to SEQ ID NO: 34

SEQ ID NO: 39 - protein, 787 aa, Triticum aestivum
MPRFSSTTPMAPPRLLLRLGARHSSSTSHPSRIWDPHAAFAAAADRARSGNLTPEDAHHLFDELLRQGNPVQERPLNNFLAALARAPASASCSDCPALAVALFGRLSRGAGRRVVQPNVFTYGVLMDCCCRACRTDLALAFFGRLLKTGLEADQVVFSTLLKGLCHAKRADEALDVLLDRMPELGCTPDVVAYTTVIHGFFREGQVGKACDLFHEMAQQGVTPDVVTYSSVIDALCKAKAMDKAEYFLGQMVDSGVVPNNVTYNSLIHGYSSSGHSKEAVRVLKKMTSQGIIPDVFTCNSLMASLCNNRKSKEAAEIFHSMAMKGLKPDIVSYSTLLHGYATEGCLVDMTNLFNSMTRDGILPNCHALNILINAYAKSGMMDEAMLIFKGMRKQGVSPDAVTYATVIHAFCRNGRLDDAVIKFNQMIDTGVRPDTAVYGSLIQGFCTHGDLVKSKELVTEMMNKGIPRPDIKFFHSIMQNLCTEGRVIEARDILGLIAHIGMRPNVVTFSVLIGGYCLVRKMADASKVFDDMVSYGLEPSNITYGILINGYCKNKRIDDGLILFKTMLHKGLKPTTFNYNVILDGLFLAGRTVAAKEKFNEMVESGVSVCIGTCSIVLGGLCRNGCSSEAITLFRKLSAMNVKFDITIVNTIIGAFYRVERNQEAKDLFAAIPANGLVPNSITYTIMMTNLIKEGSVEEADNLFLSMENSGCSANSYLLNHVIRRLLQKGEIVKAGNYMSKVDAKSFSLEAKTVSLLISLFSRKGKYREHIKLLPTKYQFLEEATVE

SEQ ID NO: 40 - protein, 787 aa, Triticum aestivum
MPRFSSTTPMAPPRLLLRLGARHSSSTSHPSRIWDPHAAFAAAADRARSGNLTPEDAHHLFDELLRQGNPVQERPLNNFLAALARAPASASCSDCPALAVALFGRLSRGAGRRVVQPNVFTYGVLMDCCCRACRTDLALAFFGRLLKTGLEADQVVFSTLLKGLCHAKRADEALDVLLDRMPELGCTPDVVAYTTVIHGFFREGQVGKACDLFHEMAQQGVTPDVVTYSSVIDALCKAKAMDKAEYFLGQMVDSGVVPNNVTYNSLIHGYSSSGHSKEAVRVLKKMTSQGIIPDVFTCNSLMASLCNNRKSKEAAEIFHSMAMKGLKPDIVSYSTLLHGYATEGCLVDMTNLFNSMTRDGILPNCHALNILINAYAKSGMMDEAMLIFKGMRKQGVSPDAVTYATVIHAFCRNGRLDDAVIKFNQMIDTGVRPDTAVYGSLIQGFCTHGDLVKSKELVTEMMNKGIPRPDIKFFHSIMQNLCTEGRVIEARDILGLIAHIGMRPNVVTFSVLIGGYCLVRKMADASKVFDDMVSYGLEPSNITYGILINGYCKNKRIDDGLILFKTMLHKGLKPTTFNYNVILDGLFLAGRTVAAKEKFNEMVESGVSVCIGTCSIVLGGLCRNGCSSEAITLFRKLSAMNVKFDITIVNTIIGAFYRVERNQEAKDLFAAIPANGLVPNSVTYTIMMTNLIKEGSVEEADNLFLSMENSGCSANSYLLNHVIRRLLQKGEIVKAGNYMSKVDAKSFSLEAKTVSLLISLFSRKGKYREHIKLLPTKYQFLEEATVE

SEQ ID NO: 41 - protein, 787 aa, Triticum aestivum; identical to SEQ ID NO: 40

SEQ ID NO: 42 - protein, 787 aa, Triticum aestivum; identical to SEQ ID NO: 40

SEQ ID NO: 43 - protein, 787 aa, Triticum aestivum; identical to SEQ ID NO: 40

SEQ ID NO: 44 - protein, 787 aa, Triticum aestivum; identical to SEQ ID NO: 40

SEQ ID NO: 45 - protein, 680 aa, Triticum aestivum
MARALPSPSSTACPEALVHGWCRCRAGRPDLVVAFFGRLLRLGLCLNVISLSNLLKGLCQVKRTNEAVDLLLHRTPELDCVPNVFSYSIVINGCFKQGEVDKACNLFHGMIQLGVQPNVVIYTSIIDALSKCGVMDKAEVVFRQMVDKGIGPDVMTCTSLIHGYSISGRWKAAVRVFKEMISLGVVPDTVMWNSFVDSLCKHRRTKEARVIFDSMAAKGQKPDTVSYSIMLNGYVKEGCFDDMTGLFNSMLQNGVVPNHHIFNILINAYAKRGLMDEAMHMFEVMRQQGVNPDVVDYQIVMDSLCKMGRMDAALDKFNQMVNQGVSPDKAVYRCLVLGSCSHGDFVKAKELISEAVNRGLCSNSVFFYPVINDLCKEGKVKEAQDMFDFIVGIGQRPDVIMYNSLMDGYCLVGKVEEALRVLDAMKSAGLQPDAITYAILLNGYCKIGRIADGLSLFREMSLLGVKPTTIMYNIILDGLFRSGRTVSAKEKFRTMSESGIPVGVDTYNIVLHGLCRNNCTDEAIELFNKLRAMKLKINVITLNTMISAMFKTRRIEEAKDLFATISAIGLVPSVVTYSVMMTNFIKEGLLAEADDMFLAMEKASCAPDSILLNQVVRALLEKGAVVKAATYLAKLDAKQLSVEASTISLIVSLFSGEGKLREHVQLLPVKYQPPESSADN

SEQ ID NO: 46 - protein, 778 aa, Triticum aestivum
MPTGRLSSIFTSNATSSFRAPSPQPRAPLAALAAATERVRAGTLSRQDAHHLFDELLSQAATVPVRTLNNFLAALARAPPSAACGDGPALAIALFNRMSQGAGARVVSPTLCTYSILMDCCCRAGRPDLVVAFFGRLIRLGLRLNVIPFNNLLKGLCKAKRSNEALDLLLHRMPELDCAPDVFSYSIVINGCFKEGEVDKACNLFHGMIQLGVQPNVVIYTSIIDALSKCGAMDKAEVVFRQMVDKGIGPDVMTCTSLIHGYSISGRWKAAVRVFKEMISLGVVPDTVMWNSFVDSLCKHRRTKEARVIFDSMAAKGQKPDTVSYSIMLNGYVKEGCFDDMTGLFNSMLQNGVVPNHHIFNILINAYAKRGLMDEAMHMFEVMRQQGVNPDVVDYQIVMDSLCKMGRMDAALDKFNQMVNQGVSPDKAVYRCLVLGSCSHGDFVKAKELISEAVNRGLCSNSVFFYPVINDLCKEGKVKEAQDMFDFIVGIGQRPDVIMYNSLMDGYCLVGKVEEALRVLDAMKSAGLQPDAITYAILLNGYCKIGRIADGLSLFREMSLLGVKPTTIMYNIILDGLFRSGRTVSAKEKFRTMSESGIPVGVDTYNIVLHGLCRNNCTDEAIELFNKLRAMKLKINVITLNTMISAMFKTRRIEEAKDLFATISAIGLVPSVVTYSVMMTNFIKEGLLAEADDMFLAMEKASCAPDSILLNQVVRALLEKGAVVKAATYLAKLDAKQLSVEASTISLIVSLFSGEGKLREHVQLLPVKYQPPESSADN

SEQ ID NO: 47 - protein, 680 aa, Triticum aestivum
MARALPSPSSTACPEALVHGWCRCRAGRPDLVVAFFGRLLRLGLCLNVISLSNLLKGLCQVKRTNEAVDLLLHRTPELDCVPNVFSYSIVINGCFKQGEVDKACNLFHGMIQLGVQPNVVIYTSIIDALSKCGAMDKAEVVFRQMVDKGIGPDVMTCTSLIHGYSISGRWKAAVRVFKEMISLGVVPDTVMWNSFVDSLCKHRRTKEARVIFDSMAAKGQKPDTVSYSIMLNGYVKEGCFDDMTGLFNSMLQNGVVPNHHIFNILINAYAKRGLMDEAMHMFEVMRQQGVNPDVVDYQIVMDSLCKMGRMDAALDKFNQMVNQGVSPDKAVYRCLVLGSCSHGDFVKAKELISEAVNRGLCSNSVFFYPVINDLCKEGKVKEAQDMFDFIVGIGQRPDVIMYNSLMDGYCLVGKVEEALRVLDAMKSAGLQPDAITYAILLNGYCKIGRIADGLSLFREMSLLGVKPTTIMYNIILDGLFRSGRTVSAKEKFRTMSESGIPVGVDTYNIVLHGLCRNNCTDEAIELFNKLRAMKLKINVITLNTMISAMFKTRRIEEAKDLFATISAIGLVPSVVTYSVMMTNFIKEGLLAEADDMFLAMEKASCAPDSILLNQVVRALLEKGAVVKAATYLAKLDAKQLSVEASTISLIVSLFSGEGKLREHVQLLPVKYQPPESSADN

SEQ ID NO: 48 - protein, 905 aa, Triticum aestivum
MHQGVGCTDPSGRGQNPRPSATSHPSLSVHSLDSSAASQAARRRPGPPEFLSLLSLRRRHASSSSPLLRASVATPRRRRAVPPSAWLVPSIAGDATRARCGGARTVSLPGGQDPRQLRAELRWRRPAMPTGRLSSIFTSNATSSFRAPSPQPRAPLAALAAATERVRAGTLSRQDAHHLFDELLSQAATVPVRTLNNFLAALARAPPSAACGDGPALAIALFNRMSQGAGARVVSPTLCTYSILMDCCCRAGRPDLVVAFFGRLIRLGLRLNVIPFNNLLKGLCKAKRSNEALDLLLHRMPELDCAPDVFSYSIVINGCFKEGEVDKACNLFHGMIQLGVQPNVVIYTSIIDALSKCGAMDKAEVVFRQMVDKGIGPDVMTCTSLIHGYSISGRWKAAVRVFKEMISLGVVPDTVMWNSFVDSLCKHRRTKEARVIFDSMAAKGQKPDTVSYSIMLNGYVKEGCFDDMTGLFNSMLQNGVVPNHHIFNILINAYAKRGLMDEAMHMFEVMRQQGVNPDVVDYQIVMDSLCKMGRMDAALDKFNQMVNQGVSPDKAVYRCLVLGSCSHGDFVKAKELISEAVNRGLCSNSVFFYPVINDLCKEGKVKEAQDMFDFIVGIGQRPDVIMYNSLMDGYCLVGKVEEALRVLDAMKSAGLQPDAITYAILLNGYCKIGRIADGLSLFREMSLLGVKPTTIMYNIILDGLFRSGRTVSAKEKFRTMSESGIPVGVDTYNIVLHGLCRNNCTDEAIELFNKLRAMKLKINVITLNTMISAMFKTRRIEEAKDLFATISAIGLVPSVVTYSVMMTNFIKEGLLAEADDMFLAMEKASCAPDSILLNQVVRALLEKGAVVKAATYLAKLDAKQLSVEASTISLIVSLFSGEGKLREHVQLLPVKYQPPESSADN

SEQ ID NO: 49 - protein, 680 aa, Triticum aestivum; identical to SEQ ID NO: 45

SEQ ID NO: 50 - protein, 778 aa, Triticum aestivum; identical to SEQ ID NO: 46

SEQ ID NO: 51 - protein, 399 aa, Triticum aestivum
MHKAELFLRQMVHNGVRPDEVTYTSMIHGYSTLGRLKEVRKIFREMTSRGLIPDIVTWNSFMDSLCKHGRTKEAAKVFFSMAAKGNKPNIVSYTILLHGYANEGSFADMMSLFNSMKGGGIVANCKVFNILIGAYAKRGLIDEAMLILTEMRGQGLSPDVVTYSTLISALWRMGKLTDAMDRFSQMVVGTGVQPDTVVYHSLVQFLCTHGDLVKAKELISEMMNKGIARPNTALFSSIMDSLRNEGRVIDAHHIFDLVIDIGEKPDSSMFSTLIDGYCLVGEMDKACGVLDAMVSAGIEPNVITYSTLVSRYCKRGRIANGLILFRQMLHKKVKPTTVTYETILNGLFRAGRTADAKKIFDEMIESGIMVSISTYNIILGGLCRNNCADEAIVLFQNVQ

SEQ ID NO: 52 - protein, 292 aa, Triticum aestivum
MSSIHLRHCSTMPMPRVCLRRRLSSSFSSSFSNCTSPPSPPWSPHAAFAAATERVRAGTLSPQDAHHLFDVLFQQATRVPERSLDGFLAALGGAASSEACRDGPALALALFNRIFREEAGMRVAPPTIFTYGILMNCCCRVRRPDLGLAFFGRILRAGLKTNQIAANTVIKCLCCAKHTDEAVNMLLHRMSDLGCVPDDFSYNTVLKSLCEDGRSLQALDLLLQMVSKEGGACSPDTVAYSTVIHGFLKEGKVDKACNLFNEMMRQGVVPDVVTYVFKAVRRGEALGGRLTA

SEQ ID NO: 53 - protein, 399 aa, Triticum aestivum; identical to SEQ ID NO: 51

SEQ ID NO: 54 - protein, 833 aa, Triticum aestivum
MSSIHLRHCSTMPMPRVCLRRRLSSSFSSSFSNCTSPPSPPWSPHAAFAAATERVRAGTLSPQDAHHLFDVLFQQATRVPERSLDGFLAALGGAASSEACRDGPALALALFNRIFREEAGMRVAPPTIFTYGILMNCCCRVRRPDLGLAFFGRILRAGLKTNQIAANTVIKCLCCAKHTDEAVNMLLHRMSDLGCVPDDFSYNTVLKSLCEDGRSLQALDLLLQMVSKEGGACSPDTVAYSTVIHGFLKEGKVDKACNLFNEMMRQGVVPDVVTYSSIIDALCKAGAMHKAELFLRQMVHNGVRPDEVTYTSMIHGYSTLGRLKEVRKIFREMTSRGLIPDIVTWNSLMDSLCKHGRTKEAAKVFFSMAAKGNKPNIVSYTILLHGYANEGSFADMMSLFNSMKGGGIVANCKVFNILIGAYAKRGLIDEAMLILTEMRGQGLSPDVVTYSTLISALWRMGKLTDAMDRFSQMVVGTGVQPDTVVYHSLVQFLCTHGDLVKAKELISEMMNKGIARPNTALFSSIMDSLRNEGRVIDAHHIFDLVIDIGEKPDSSMFSTLIDGYCLVGEMDKACGVLDAMVSAGIEPNVITYSTLVSRYCKRGRIANGLILFRQMLHKKVKPTTVTYETILNGLFRAGRTADAKKIFDEMIESGIMVSISTYNIILGGLCRNNCADEAIVLFQKLRAMNVKFNITTLNTIINALYKVERREEANDLFAALPASGLVPNASTYGVMVQNLLKEGAVEEADSMFSSMEKSGCAPSSRLINDVIRTLLEKGEIVKAGKYMSKVDGKSISLEASTSSLLLSLFSGNGKYRKQLQLLPAKYQFFKGIS

SEQ ID NO: 55 - protein, 292 aa, Triticum aestivum; identical to SEQ ID NO: 52

SEQ ID NO: 56 - protein, 292 aa, Triticum aestivum; identical to SEQ ID NO: 52

SEQ ID NO: 57 - protein, 836 aa, Triticum aestivum
MSSIHLRHCSTMPMSRVCLRRRLSSSSSSSSSSFSNCTSPPSPPWSPHAAFAAATERVRAGTLSPQDAHHLFDVLFQQATRVPERSLDGFLAALGGAASSEACRDGPALALALFNRIFREEAGMRVAPPTIFTYGILMNCCCRVRRPDLGLAFFGRILRAGLKTNQIAANTVIKCLCYAKHTDEAVNMLLHRMSDLGCVPDDFSYNTVLKSLCEDGRSLQALDLLLQMVSKEGGACSPDTVAYSTVIHGFLKEGKVDKACNLFNEMMRQGVVPDVVTYSSIIDALCKAGAMHMAELFLRQMVDNDVRPDEVTYTSMIHGYSTLGRLKEVRKMFREMTSRGLIPDIVTWNSFIDSLCKHGRTKEAAKVFFSMAAKGSKPNIVSYTILLHGYANEGSFADMMSLFNSMKGGGIVANCKVFNILIGAYAKRGLIDEAMLILTEMRGQGLSPDVFTYSTLISAHWRMGKLTDAMDKFSQMVVGTGVQPDAVVYHSLVQFLCTHGDLVKAKELLSEMMNKSIARPNTALFSSIMDSLCNEGRVIDAHHIFDLVIDIGEKPDISMFSMLIDGYCLVGEMDKACGVLDAMVSAGIEPNVITYSTLVSRYCKRGRIDDGLILFRQMLHKKVKPTTVTYETILNGLFRAGRTVDAKKIFDEMIESGIMVSISTYNIILGGLCRNNCADEAIVLFQKLRAMNVKFNITTLNTIINALYKVERREEANDLFAALPASGLVPNASTYGVMVQNLLKEGAVEEADSMFSSMEKTGCAPSSRLINDVIRTLLEKGEIVKAGKYMSKVDGKSISLEASTSSLLLSLFSGNGKYRKQLQLLPAKYQFFEGIS

SEQ ID NO: 58 - protein, 399 aa, Triticum aestivum; identical to SEQ ID NO: 51

SEQ ID NO: 59 - protein, 399 aa, Triticum aestivum; identical to SEQ ID NO: 51

SEQ ID NO: 60 - protein, 292 aa, Triticum aestivum; identical to SEQ ID NO: 52

SEQ ID NO: 61 - protein, 833 aa, Triticum aestivum; identical to SEQ ID NO: 54

SEQ ID NO: 62 - protein, 824 aa, Triticum aestivum
MPRLRLRRFSTAPMFHLLHRSSSSTSTSPPSRSWSPHAAFAAATERVRAGTLSPEDAHHLFDELLRQATPVTGRSLNGFLSALARAPASAACIRDGPALAVALFNRVCREEASQQVAPLTVHTYGILMGCFCGARRPDLGLALFGRFLRTGLKTNEIIATTFLKCLCSAKRTDEAVNLLLHRMPELGCVPNAISYSIVLKSLCENSMSQRALDLLQTVAEGGGACSLNVVAYSTVIHGFFKEGKTGKACNLFHEMIHQGVDPDVVTYNLIIDALCKARAMDKAELVLQQMVDKGVQPNTVTYNCMIHGYSTSGQLKEAAKMFRKMTSHGLVPNAVTCNLLMTSLCKHGRSKEAAEIFYSMTAKGHKLDAVSYRILLHGYATEGCFADMIDLFNSMESNGFVADCHVFTILIDAYAKRGMMDEAMLIFTEMREKGVSPNVVTYSTVIAAFCRLRRLANAMDKFNEMTDMGVQPDTTVYHSLIQGFCMHGDLVKVKEFVSEMMNKGIPRPDIAFFNSVINSLCKEGRVMNAQGIFDLVIGMGERPNVITFSSLIDGYGLVGQMGEALGVLDAMVSAGIEPNVVTYSSILDGYCRNGRINDALILFREMPRKRIKPNTVTYGIMLDGLFRAGRTVAAREMFHEMTERGIPVSISIYNIILGGLCRNNCADEAITLFQKLGAMNVKFDIITLNTMINAMFKVRRREEANDLFAAVSASGLVPNASTYGIVIKNILKEGSVEEVDNMFSSMEKSGCAPSSRLINYIIRMLLEKGEIARAGNYLSKVDGKIISLEASTTSLLLSLFSREGKYRENIELLPAKYQFFNGFG

SEQ ID NO: 63 - protein, 597 aa, Triticum aestivum
MWWHIAQSSMVFFKEGKTGKACNLFHEMIHQGVDPDVVTYNLIIDALCKARAMDKAELVLQQMVDKGVQPNTVTYNCMIHGYSTSGQLKEAAKMFRKMTSHGLVPNAVTCNLLMTSLCKHGRSKEAAEIFYSMTAKGHKLDAVSYRILLHGYATEGCFADMIDLFNSMESNGFVADCHVFTILIDAYAKRGMMDEAMLIFTEMREKGVSPNVVTYSTVIAAFCRLRRLANAMDKFNEMTDMGVQPDTTVYHSLIQGFCMHGDLVKVKEFVSEMMNKGIPRPDIAFFNSVINSLCKEGRVMNAQGIFDLVIGMGERPNVITFSSLIDGYGLVGQMGEALGVLDAMVSAGIEPNVVTYSSILDGYCRNGRINDALILFREMPRKRIKPNTVTYGIMLDGLFRAGRTVAAREMFHEMTERGIPVSISIYNIILGGLCKNNCADEAIALFQKLGAMNVKFDIITLNTMINAMFKVRRREEANDLFAAVSASGLVPNASTYGIVIKNILKEGSVEEVDNMFSSMEKSGCAPSSRLINYIIRMLLEKGEIARAGNYLSKVDGKIISLEASTTSLLLSLFSREGKYRENIELLPAKYQFFNGFG

SEQ ID NO: 64 - protein, 356 aa, Triticum aestivum
MLFPDEFLQTNKKICQSLARKIFRVFGIYLPFLKFYFTVYKRAFEIGTGYSSSRPFSLSQCRARARPCLASPSAAAAAHRPPPRQCPASTTPPPPPPSHSPTSASATSPPLSPTSPMPRLRLRRFSTAPMFHLLHRSSSSTSTSPPSRSWSPHAAFAAATERVRAGTLSPEDAHHLFDELLRQATPVTGRSLNGFLSALARAPASASCIRDGPALAVALFNRVCREEASQQVAPLTVHTYGILMGCFCGARRPDLGLALFGRFLRKGLKTNEIIATTFLKCLCSAKRTDEAVNLLLHRMPELGCVPNAISYSIVLKSLCENSMSQRALDLLQTVAEGGGACSLNVVAYSTVIHGFF

SEQ ID NO: 65 - protein, 193 aa, Triticum aestivum
MIVRLSGHPLVRDSLNEAVNLLLHRMPELGCVPNAISYSIVLKSLCENSMSQRALNLLQTVAEGGGACSLNVVAYNTVIHGIFKEGKTGKACNLFHEMIHQGVDPDVVTYNLIIDALCKARAMDKAELVLQQMVDKGVQPNTVTYNCMIHGYSTSGQLKEAAKMFRKMTSHGLVPNAVTCNSLMTSLCKHGRS

SEQ ID NO: 66 - protein, 824 aa, Triticum aestivum
MPRLRLRRFSTAPMFHLLHRSSSSTSTSPPSRSWSPHAAFAAATERVRAGTLSPEDAHHLFDELLRQATPVTGRSLNGFLSALARAPASAACIRDGPALAVALFNRVCREEASQQVAPLTVHTYGILMGCFCGARRPDLGLALFGRFLRTGLKTNEIIATTFLKCLCSAKRTDEAVNLLLHRMPELGCVPNAISYSIVLKSLCENSMSQRALDLLQTVAEGGGACSLNVVAYSTVIHGFFKEGKTGKACNLFHEMIHQGVDPDVVTYNLIIDALCKARAMDKAELVLQQMVDKGVQPNTVTYNCMIHGYSTSGQLKEAAKMFRKMTSHGLVPNAVTCNLLMTSLCKHGRSKEAAEIFYSMTAKGHKLDAVSYRILLHGYATEGCFADMIDLFNSMESNGFVADCHVFTILIDAYAKRGMMDEAMLIFTEMREKGVSPNVVTYSTVIAAFCRLRRLANAMDKFNEMTDMGVQPDTTVYHSLIQGFCMHGDLVKVKEFVSEMMNKGIPRPDIAFFNSVINSLCKEGRVMNAQGIFDLVIGMGERPNVITFSSLIDGYGLVGQMGEALGVLDAMVSAGIEPNVVTYSSILDGYCRNGRINDALILFREMPRKRIKPNTVTYGIMLDGLFRAGRTVAAREMFHEMTERGIPVSISIYNIILGGLCRNNCADEAITIFQKLGAMNVKFDIITLNTMINAMFKVRRREEANDLFAAVSASGLVPNASTYGIVIKNILKEGSVEEVDNMFSSMEKSGCAPSSRLINYIIRMLLEKGEIARAGNYLSKVDGKIISLEASTTSLLLSLFSREGKYRENIELLPAKYQFFNGFG

SEQ ID NO: 67 - protein, 339 aa, Triticum aestivum
MHGDLVKVKEFVSEMMNKGIPRPDIAFFNSVINCLCKEGRVMNAQGIFDLVIGMGERPNVITFSSLIDGYGLVGQMGEALGVLDAMVSAGIEPNVVMYSSILDGYCRNGRINDALILFREMPRKRIKPNTVTYGIMLDGLFRAGRTVAAREMFHEMTERGISVSISIYNIILSGLCRNNCADEAIALFQKLGAMNVKFDIITLNTMINAMFKVRRREEANDLFAAVSASGLVPTASTYGIVIKNILKEGSVEEVDNIFSSMEKSGCAPSSRLINYIIRMLLEKGEIARAGNYLSKVDGKIISLEASTTSLLLSLFSREGKYRENIELLPAKYQFFNGFG

SEQ ID NO: 68 - protein, 356 aa, Triticum aestivum; identical to SEQ ID NO: 64

SEQ ID NO: 69 - protein, 597 aa, Triticum aestivum; identical to SEQ ID NO: 63

SEQ ID NO: 70 - protein, 597 aa, Triticum aestivum; identical to SEQ ID NO: 63

SEQ ID NO: 71 - protein, 356 aa, Triticum aestivum; identical to SEQ ID NO: 64

SEQ ID NO: 72 - protein, 824 aa, Triticum aestivum; identical to SEQ ID NO: 62

SEQ ID NO: 73 - protein, 409 aa, Triticum aestivum
MVSYGMDEAMHMFEVMRQQGVNPDVFGYQIIMDSLCKMGKMAAAMDIFNQMVNQGVSPNKAVYQCLVLGSCSHGHFVKAKELISEAVNRGLCSNSVFFYPVINDRCKEGKVKEAQDMFDFIVGIGHRPDVIMYNSLMDGYCHVGKVEEALRVLDAMKSAGLQPDVFTYGILINGYCKIGRIDEGLSLVREISLSGVKPTTIMYNIILDGLFCSGRTVPAKEKFHKMNESGIPVGVGTYNIVLSGLCKNNCTDEAIELFKKLRAVNVKINVITLTTMISAMFKTRRIEEAKDLFATISAIGLVPSVVTYSIMMTNFIKEGLLADADDMFSAMEKAGCAHNSRLLNQVVRVFLKNGEVVKAVTYLAKLDAKQLSVEASTVSLIVSLFSRKGKLREHVKLLPVKYQPPEMLD

SEQ ID NO: 74 - protein, 409 aa, Triticum aestivum; identical to SEQ ID NO: 73

SEQ ID NO: 75 - protein, 409 aa, Triticum aestivum; identical to SEQ ID NO: 73

SEQ ID NO: 76 - protein, 466 aa, Triticum aestivum
MTAKGQKPDIISYCTLLHGHAREGCFTDMIDLFNSMKSNGIAADCHVFTILIDTYAKRGMMDDAMHIFTEMQQQGVSPNVVTYSTVISALSRMGRLTDAMEKFNQMVALGVQPDRAIYQSLIQGFCMHGGLVKAKELVSQMINKGIPHPNIVFFNSVINSMCKEGRVMDAHDIFDLVIDIGDRPDDTSFNSLIDGYCLVGKMDKAFGMLNAMESVGVEPDIVTYSTLVNGYCRNGRIDDGLTLFREMMCKGVKPTTVTYGIILDGLFHSGRTVAAMKMFHQMIESGTTVTISTYSIILGGLCRNNCADEAIVLFQKLGAMIVKFSITILNTMINAMYKVQRKEEAKELFGTISASGLVPNECTYGVMIKNLLEEGSVEEADNMFSFMDRSGIVPSSRLMNDIIRMLLEKGEIAKAGYYLSKVDGKSISLEASTTSLMFSLFSRKSKYQEDMKLLPAKYQIFDGLVV

SEQ ID NO: 77 - protein, 873 aa, Triticum aestivum
MSRRIRLRRALLLRLKSGLRHSFTSPFSRLRIRLRRYSTAPMSRLRLRLPRGSSSPTTLIPRLRLLRRCSTSTSMSSPSRSWSPRDAFAAATERVRAGTLSLEDAHKLFDELLGQATPVPERSLNGFLAALARAPASGACIRDGPALAVALFNRVCREEAGAQVAALTVCTYNILMDCCCRARRPDLGLALFGCFLRKGLKTDQTGANTFLKCLCYAKRTDEAVNVLLHRMSELGCVPNAVSYNTVLKGLCDNSMSQRALDLLQMVAGKGGGCFPDVVAYSTVIHGFFKEGETGKACSLFHEMMQQGIVPSVVTYNSIIDALCKVREVDKAELVLRQMVAKGAQPDTVTYNCMINGYATSGRLKEAAKMFREMKSRGLTPNVVTCNSFLASLCKHRSSKEAAEFFDSMTAKGQKPDIISYCTLLHGHAREGCFTDMIDLFNSMKSNGIAADCHVFTILIDTYAKRGMMDDAMHIFTEMQQQGVSPNVVTYSTVISALSRMGRLTDAMEKFNQMVALGVQPDRATYQSLIQGFCMHGGLVKAKELVSQMINKGIPHPNIVFFNSVINSMCKEGRVMDAHDIFDLVIDIGDRPDDTSFNSLIDGYCLVGKMDKAFGMLNAMESVGVEPDIVTYSTLVNGYCRNGRIDDGLTLFREMMCKGVKPTTVTYGIILDGLFHSGRTVAAMKMFHQMIESGTTVTISTYSIILGGLCRNNCADEAIVLFQKLGAMNVKFSITILNTMINAMYKVQRKEEAKELFGTISASGLVPNECTYGVMIKNLLEEGSVEEADNMFSFMDRSGIVPSSRLMNDIIRMLLEKGEIAKAGYYLSKVDGKSISLEASTTSLMFSLFSRKSKYQEDMKLLPAKYQIFDGLVV

SEQ ID NO: 78 - protein, 873 aa, Triticum aestivum
MSRRIRLRRALLLRLKSGLRHSFTSPFSRLRIRLRRYSTAPMSRLRLRLPRGSSSPTTLIPRLRLLRRCSTSTSTSSPSRSWSPRDAFAAATERVRAGTLSLEDAHKLFDELLGQATPVPERSLNGFLAALARAPASGACIRDGPALAVALFNRVCREEAGAQVAALTVCTYNILMDCCCRARRPDLGLALFGCFLRKGLKTDQTGANTFLKCLCYAKRTDEAVNVLLHRMSELGCVPNAVSYNTVLKGLCDNSMSQRALNLLQMVAGKGGGCFPDVVAYSTVIHGFFKEGETGKACSLFHEMMQQGIVPSVVTYNSIIDALCKVREVDKAELVLRQMVAKGAQPDTVTYNCMINGYATSGRLKEAAKMFREMKSRGLTPNVVTCNSFLASLCKHRSSKEAAEFFDSMTAKGQKPDIISYCTLLHGHAREGCFTDMIDLFNSMKSNGIAADCHVFTILIDTYAKRGMMDDAMHIFTEMQQQGVSPNVVTYSTVISALSRMGRLTDAMEKFNQMVALGVQPDRAIYQSLIQGFCMHGGLVKAKELVSQMINKGIPHPNIVFFNSVINSMCKEGRVMDAHDIFDLVIDIGDRPDDTSFNSLIDGYCLVGKMDKAFGMLNAMESVGVEPDIVTYSTLVNGYCRNGRIDDGLTLFREMMCKGVKPTTVTYGIILDGLFHSGRTVAAMKMFHQMIESGTTVTISTYSIILGGLCRNNCADEAIVLFQKLGAMNVKFSITILNTMINAMYKVQRKEEAKELFGTISASGLVPNECTYGVMIKNLLEEGSVEEADNMFSFMDRSGIVPSSRLMNDIIRMLLEKGEIAKAGYYLSKVDGKSISLEASTTSLMFSLFSRKSKYQEDMKLLPAKYQIFDGLVV

SEQ ID NO: 79 - protein, 873 aa, Triticum aestivum; identical to SEQ ID NO: 78

SEQ ID NO: 80 - protein, 832 aa, Triticum aestivum
MSRLRLRLPRGSSSPTTLIPRLRLLRRCSTSTSTSSPSRSWSPRDAFAAATERVRAGTLSLEDAHKLFDELLGQATPVPERSLNGFLAALARAPASGACIRDGPALAVALFNRVCREEAGAQVAALTVCTYNILMDCCCRARRPDLGLALFGCFLRKGLKTDQTGANTFLKCLCYAKRTDEAVNVLLHRMSELGCVPNAVSYNTVLKGLCDNSMSQRALDLLQMVAGKGGGCFPDVVAYSTVIHGFFKEGETGKACSLFHEMMQQGIVPSVVTYNSIIDALCKVREVDKAELVLRQMVAKGAQPDTVTYNCMINGYATSGRLKEAAKMFREMKSRGLTPNVVTCNSFLASLCKHRSSKEAAEFFDSMTAKGQKPDIISYCTLLHGHAREGCFTDMIDLFNSMKSNGIAADCHVFTILIDTYAKRGMMDDAMHIFTEMQQQGVSPNVVTYSTVISALSRMGRLTDAMEKFNQMVALGVQPDRAIYQSLIQGFCMHGGLVKAKELVSQMINKGIPHPNIVFFNSVINSMCKEGRVMDAHDIFDLVIDIGDRPDDTSFNSLIDGYCLVGKMDKAFGMLNAMESVGVELDIVTYSTLVNGYCRNGRIDDGLTLFREMMCKGVKPTTVTYGIILDGLFHSGRTVAAMKMFHQMIESGTTVTISTYSIILGGLCRNNCADEAIVLFQKLGAMIVKFSITILNTMINAMYKVQRKEEAKELFGTISASGLVPNECTYGVMIKNLLEEGSVEEADNMFSFMDRSGIVPSSRLMNDIIRMLLEKGEIAKAGYYLSKVDGKSISLEASTTSLMFSLFSRKSKYQEDMKLLPAKYQIFDGLVV

SEQ ID NO: 81 - protein, 873 aa, Triticum aestivum; identical to SEQ ID NO: 78

SEQ ID NO: 82 - protein, 695 aa, Triticum aestivum
MDCCCRASRPDLGLAFFGRLLRTGLKTNEIVASTFLKCLCYANRKEEAVNVLLHRMPELGCVPDAFSYSIVLKSLCDNNTSQRGLLQMMAKEGGGCSPNVVAYSTVIHGFFKEGETGKACSLFHQMMQQGVVPNVVTYNSIIDALCKARAMDKAELVLRQMVANGAQPNEVTYTCMIHGYSTSGRLKEAAKMFREMKSRGLTPNTVTCGSLMTSLCKHGRSKEAREIFDSMTAKGHKPDIVSYRILLHGYASEGCFADMIDLCNSMESNGIAADCRVFTILIDAYAKRGMMDDAMHIFTEMQQRGVSPNVVTYSTVISALSRMGRLTDAMEKFNQMVALGVQPNIPVYWSLIQGFCMHGGLVKVKELVSQMINKGIPRPNIVFFNSVINGMCKEGRVMDAHDIFDLVIDLGGRPDVITFNSLIDGYCLARKLDKAFGMFNSMESVGVEPDIVTYSTLLDGYFKNRRINDGLALFREMPRKRIKPDIVTYGIMLDGLFRAGRTVAARTMFHEMIESGITVDIPTYNIVLRGLCRNNCTDEAIALFQKLGAMSMKFNIAILNTMINAMYKVRRREEANNLFAAISTSGLVPNQSTYAVMIINLLKDGAVEHASNMFSSMEKSGIVPSSRLINGIIRLLLENGEIAKAGIYLSKVDGNSISLEASTTSLMLSLFSRKGKYHEDMKLLPAKYQFFDGCS

SEQ ID NO: 83 - protein, 695 aa, Triticum aestivum; identical to SEQ ID NO: 82

SEQ ID NO: 84 - protein, 695 aa, Triticum aestivum
MDCCCRASRPDLGLAFFGRLLRTGLKTNEIVASTFLKCLCYANRKEEAVNVLLHRMPELGCVPDAFSYSIVLKSLCDNNTSQRGLLQMMAKEGGGCSPNVVAYSTVIHGFFKEGETGKACSLFHQMMQQGVVPNVVTYNSIIDALCKARAMDKAELVLGQMVANGAQPNEVTYTCMIHGYSTSGRLKEAAKMFREMKSRGLTPNTVTCGSLMTSLCKHGRSKEAREIFDSMTAKGHKPDIVSYRILLHGYASEGCFADMIDLCNSMESNGIAADCRVFTILIDAYAKRGMMDDAMHIFTEMQQRGVSPNVVTYSTVISALSRMGRLTDAMEKFNQMVALGVQPNIPVYWSLIQGFCMHGGLVKAKELVSQMINKGIPRPNIVFFNSVINGMCKEGRVMDAHDIFDLVIDLGGRPDVITFNSLIDGYCLARKLDKAFGMFNSMESVGVEPDIVTYSTLLDGYFKNRRINDGLALFREMPRKRIKPDIVTYGIMLDGLFCAGRTVAARTMFHEMIESGITVDIPTYNIVLRGLCRNNCTDEAIALFQKLGAMSMKFNIAILNTMINAMYKVRRREEANNLFAAISTSGLVPNQSTYAVMIINLLKDGAVEHASNMFSSMEKSGIVPSSRLINGIIRLLLENGEIAKAGIYLSKVDGNSISLEASTTSLMLSLFSRKGKYHEDMKLLPAKYQFFDGCS

SEQ ID NO: 85 - protein, 695 aa, Triticum aestivum; identical to SEQ ID NO: 82

SEQ ID NO: 86 - protein, 695 aa, Triticum aestivum
MDCCCRASRPDLGLAFFGRLLRTGLKTNEIVASTFLKCLCYANRKEEAVNVLLHRMPELGCVPDAFSYSIVLKSLCDNNTSQRGLLQMMAKEGGGCSPNVVAYSTVIHGFFKEGETGKACSLFHQMMQQGVVPNVVTYNSIIDALCKARAMDKAELVLRQMVANGAQPNEVTYTCMIHGYSTSGRLKEAAKMFREMKSRGLTPNTVTCGSLMTSLCKHGRSKEAREIFDSMTAKGHKPDIVSYRILLHGYASEGCFADMIDLCNSMESNGIAADCRVFTILIDAYAKRGMMDDAMHIFTEMQQRGVSPNVVTYSTVISALSRMGRLTDAMEKFNQMVALGVQPNIPVYWSLIQGFCMHGGLVKAKELVSQMINKGIPRPNIVFFNSVINGMCKEGRVMDAHDIFDLVIDLGGRPDVITFNSLIDGYCLARKLDKAFGMFNSMESVGVEPDIVTYSTLLDGYFKNRRINDGLALFREMPRKRIKPDIVTYGIMLDGLFRAGRTVAARTMFHEMIESGITVDIPTYNIVLRGLCRNNCTDEAIALFQKLGAMSMKFNIAILNTMINAMYKVRRREEANNLFAAISTSGLVPNQSTYAVMIINLLKDGAVEHASNMFSSMEKSGIVPSSRLINGIIRLLLENGEIAKAGIYLSKVDGNSISLEASTTSLMLSLFSRKGKYHEDMKLLPAKYQFFDGCS

SEQ ID NO: 87 - protein, 695 aa, Triticum aestivum; identical to SEQ ID NO: 82

SEQ ID NO: 88 - protein, 695 aa, Triticum aestivum
MDCCCRARRPDLGLALFGCILRTGLKIDQITANTLLKCLCYAKQTEEAVYVLLHRMSELSCVPDAFAYNIVLKSLCKGSRSQRAHDLLRTMAKDRGGCFPDVVTYTTVIHGFFKEGETGKACNLFHEMIHQGVEPDVATYNSVIDALCKARAMDKAEVVLQQMVDKGVQPDTVTYTCMINGYSTSGRLKEAAKMFREMKSRGLIPDIVTCNSFLASICKHGTSKEAAEFFDAMTAKGHKPNIVSYRILLHGYATEGCFPDMIDVFNSMESNGIAADCHVFNILIDAKRGMMDEAMLISSKMQERRVNPDVVTYSSIIAGLSRLGRLTEAMEKFNQMIALGVQPNKAVYHALIQGFCIDGDLAKAKQLVYEMMDRGIPRPNISFFSSVIKSLCQEGRVMDAHDIFDLVIDMGERPDGILFNSLIDGYCLVGKMDKALKVLDVMESVGVEPDVFTYSTLVNGYCRNGRIDDGLTLFREMPRKRIKPDTVSYRVIMVGLFRAGRTVAARKMFHEMIESGTMVDIFTYNIILGGLCRNNCADEAIALFQKLRAMNVKFDITTLNTMINAMYNVQRKEEAKDLFATISASGLVPNESTYRVMIKNLLEEGSVEKADSMFSLMDKSGIAPSSRLLNDIIRMLLEKGEITKAGNYLSKVDGKSISLEASTTSLMLSLFSREGKYREDMKLLPAKYQFFDGFC

SEQ ID NO: 89 - protein, 695 aa, Triticum aestivum
MDCCCRTRRPDLGLALFGCILRTGLKIDQITANTLLKCLCYAKQTEEAVYVLLHRMSELSCVPDAFAYNIVLKSLCKGSRSQRAHDLLRTMAKDRGGCFPDVVTYTTVIHGFFKEGETGKACNLFHEMIHQGVEPDVATYNSVIDALCKARAMDKAEVVLQQMVDKGVQPDTVTYTCMINGYSTSGRLKEAAKMFREMKSRGLIPDIVTCNSFLASICKHGTSKEAAEFFDAMTAKGHKPNIVSYRILLHGYATEGCFPDMIDVFNSMESNGIAADCHVFNILIDAKRGMMDEAMLISSKMQERRVNPDVVTYSSIIAGLSRLGRLTEAMEKFNQMIALGVQPNKAVYHALIQGFCIDGDLAKAKQLVYEMMDRGIPRPNISFFSSVIKSLCQEGRVMDAHDIFDLVIDMGERPDGILFNSLIDGYCLVGKMDKALKVLDVMESVGVEPDVFTYSTLVNGYCRNGRIDDGLTLFREMPRKRIKPDTVSYRVIMVGLFRAGRTVAARKMFHEMIESGTMVDIFTYNIILGGLCRNNCADEAIALFQKLRAMNVKFDITTLNTMINAMYNVQRKEEAKDLFATISASGLVPNESTYRVMIKNLLEEGSVEKADSMFSLMDKSGIAPSSRLLNDIIRMLLEKGEITKAGNYLSKVDGKSISLEASTTSLMLSLFSREGKYREDMKLLPAKYQFFDGFC

SEQ ID NO: 90 - protein, 695 aa, Triticum aestivum; identical to SEQ ID NO: 88

SEQ ID NO: 91 - protein, 586 aa, Triticum aestivum
MAFSRRAKQACNLFHEMIHQGVEPDVATYNSVIDALCKARAMDKAEVVLQQMVDKGVQPDTVTYTCMINGCSTSGRLKEAAKMFREMKSRGLIPDIVTCNSFLASICKHGTSKEAAEFFDAMTAKGHEPNIVSYRILLHGYATEGCFPDMIDVFNSMESNGIAADCHVFNILIDAYAKRGMMDEAMLISSKMQERRVNPDVVTYSSIIAGLSRLGRLTEAMEKFNQMIALGVQPNKAVYHALIQGFCIDGDLAKAKQLVSEMMNRGIPRPNISFFSSVIKSLCQEGRVMDAHDIFDLVIDMGERPDGILFNSLIDGYCLVGKMDKALKVLDVMESVGVEPDVFTYSTLVNGYCRNGRIDDGLTLFREMPRKRIKPDTVSYRVIMVGLFRAGRTVAARKMFHEMIESGTMVDIFTYNIILGGLCRNNCADEAIALFQKLRAMNVKFDITTLNTMINAMYNVQRKEEAKDLFATISASGLVPNESTYRVMIKNLLEEGSVEKADSMFSLMDKSGIAPSSRLLNDIIRMLLEKGEIAKAGNYLSKVDGKSISLEASTTSLMLSLFSREGKYREDMKLLPAKYQFFDGFC

SEQ ID NO: 92 - protein, 695 aa, Triticum aestivum; identical to SEQ ID NO: 89

SEQ ID NO: 93 - protein, 695 aa, Triticum aestivum; identical to SEQ ID NO: 88

SEQ ID NO: 94 - protein, 695 aa, Triticum aestivum; identical to SEQ ID NO: 89

SEQ ID NO: 95 - protein, 792 aa, Triticum aestivum
MVFPRRICRGHGARPRRDAQTGGRTPPVRPIATTDHPGPRALPAWIFLAALARATPSAACKDGPSLALALFNRVCREEAGRRVAPPTVHTYGILMNCCCLVRRPDLGLALFGRLLRTGLKTNEIVASTILKCLCCAKRTDEAVNVLLHRMSDLGCVPNVFSYNRVLKSLCEDGRSQRALDLLRVMAKGDGDGCSPCVVSYSTVIYGFFKEGKVGKACNLFHEMTQQGIVSDVVTYNSIIDALCKARAMDKAELFLRQMVDDDIRPNGVTYTAIIHGYSTLGQWKKATQMFREMTSRGLVPNTVTWNSFMASLCKHGRSKEVAELLYSMAVKGHKPNVVSYSILLHGYATEGCFADMVNLFNSMVGKGIVPDHHVFNIFINAYAKCGMMDEAMHMLTEMREQGMSPDMCTYATIIAALCRMGRLADAVDNFNQMIGKGVQPSKVVYRSLIQGFCTHGDLVKAKEFISEMTDKCICRPTIVFFSSIMHSLCNEGRVIDAHHIFDLVIDIGERPDLIAFNTLIDGYCLVGNMEKALGVLDSMVSAGIEPTVVTYSSLISGYCKSGRLDDGVILFREMEHKRVKPDTVTYNIILDGLFHAGGTIAAKKLFNEMVESGTVVSISTYRIVLGGLCRNNCTNEAIVLFQKLGAMNVKFDIAILNTMINAMYKVQRREEANDLFASLPACGLVPNASTYGVVIQNLLKEGPLEEADNMFSSMEKSGCVPSSRLINDIIRTLLEKGEIVKAANYMSKIDGKIISFEASTTSLMLSLFSEKGKYQEQLQLLPAKYHFFGGVI

SEQ ID NO: 96 - protein, 792 aa, Triticum aestivum; identical to SEQ ID NO: 95

SEQ ID NO: 97 - protein, 792 aa, Triticum aestivum; identical to SEQ ID NO: 95

SEQ ID NO: 98 - protein, 792 aa, Triticum aestivum; identical to SEQ ID NO: 95

SEQ ID NO: 99 - protein, 792 aa, Triticum aestivum; identical to SEQ ID NO: 95

SEQ ID NO: 100 - protein, 792 aa, Triticum aestivum; identical to SEQ ID NO: 95

SEQ ID NO: 101 - protein, 882 aa, Triticum aestivum
MPSRIPPPMPRRICVWLRCSSPSSSCTYPDSGLRHPSCLTSPLSGLRLRRSFTTPMSNLRLRCSFTTPMSNLRLFRRSSSSTSTPTSPSSRSWSPHAAFAAATERVRAGTLNQDDTHNLFDELLRQAIPVPGRSLNGFLAALARATSSAACIRDGPALTVALFNRVCREQAGPRVAPLTVHTYNILMDCCCRASRPDLGLAFFGRLLRTGLKTNEIVATTFLKCLCYAKRTDEAVNVLLHRMPELGCVPDAFAYSTVLKSLCDNSMSQRGLDLLHMMAKEGGGCSPNVVAYSTVIHGFFKEGETGKACNLFHEMMQQGVEPNVWTYSSIIDALCKARAMDKAELVLQQMVNKGVQPNNVTYNCMIHGYSTSGWWKEVVKLFREMKSRGLIPDIFTCNSLMTYLCKHGRSKEAAEFFDAVTAKGHRDVISYCILLHGYANEGCFADMIDLFNSMQRNGIAANCHVFNILINGYAKRGMTEEAMLIFTKMWEKGVSPDVVTYSIVIAALSRMGRLTDAMEKFNQMIAMGIQPNTAVYHSLIQGFCIDGDLVKAKQLVSEMMNRGIPRPNIVFFNSVINSLCKEGRVMDAHDVLDLVVGIGERPNVITFSSLIDGYCSVGNMDKAFKILDVMESVGVEPNVVTYSALLDGYSKNRRIDDALTLFREMPRKRIKPDTVTCGIMLDGLFRAGRTVAAMEMFHEMTESGTTVDIFIYNIILGGLCRNNCVDEAIALFQKLRAMNVKFNIEILNTMINAMYKVQRKEEAKELFATISANGLVPNESTYAVMIRNLLKDGAVEDADNMFSSMDNSGIVPSSRLINDIIRMLLEKGEIAKAGNYLSKVDGKSISLEASTTSLMLSLFSRKGKHQEDIKLLPAKYQIFDGFS

SEQ ID NO: 102 - protein, 544 aa, Triticum aestivum
MDKAELVLQQMVNKGVQPNNVTYNCMIHGYSTSGWWKEVVKLFREMKSRGLIPDIFTCSSLMTYLCKHGRSKEAAEFFDAVTAKGHRDVISYCILLHGYANEGCFADMIDLFNSMQRNGIAANCHVFNILINGYAKRGMTEEAMLIFTEMWEKGVSPDVVTYSIVIAALSRMGRLTDAMEKFNQMIAMGIQPNTAVYHSLIQGFCIDGDLVKAKQLVSEMMNRGIPRPNIVFFNSVINSLCKEGRVMDAHDVLDLVIGIGERPNVITFNSLIDGYCLVGNMDKAFKILDVMESVGVEPNVVTYSALLDGYSKNRRIDDALTLFREMPRKRIKPDTVTYGIMLDGLFRAGRTVAAMEMFHEMTESGTTVDILIYNIILGGLCRNNCVDEAIALFQKLRAMNVKFNIEILNTMINAMYKVQRKEEAKELFATISANGLVPNESTYAVMIRNLLKGGAVEDADNMFSSMDNSGIVRSSGLINDIIRMLLKKGEIAKAGNYLSKVDGKSISLEASTTSLLLSLFSRKGKHQVDIKLLPAKYQFFDGFG

SEQ ID NO: 103 - protein, 544 aa, Triticum aestivum; identical to SEQ ID NO: 102

SEQ ID NO: 104 - protein, 544 aa, Triticum aestivum; identical to SEQ ID NO: 102

SEQ ID NO: 105 - protein, 219 aa, Triticum aestivum
MPRKRIKPDTVTYGIMLDGLFRAGRIVAAMEMFHEMTESGTTVDILIYNIILGGLCRNNCVDEAIALFQKLRAMNVKFNIEILNTMINAMYKVQRKEEAKELFATISANGLVPNESTYAVMIRNLLKDGAVEDADNIFSSMDNSGIVPSSRLINDIIRMLLEKGEIAKAGNYLSKVDGKSISLEASTTSLMLSLFSRKGKHQEDIKLLPAKYQFFDGFG

SEQ ID NO: 106 - protein, 789 aa, Triticum aestivum
MVSPRRLCRGHGARPCRDAQPGGRTPPVQPIATAGHSGPRALPGRLPCRPRPCARLSCLQRWPRPRHRPLQPRMPRRSRPAGGAAHSLHLRHPDELLLPRASSGPRACLIWPPPKDRPQTNEIVASTVLKCLCCAKRTDEAVNVLIHRMSDLGCVPNEFSYKTVLKSLCEDSRSQRALDLLRVMAKGDGCSPCVVSYSTVIYGFFKEGKVGKACNLFHEMTQQGVVSDVVTYNSIIDALCKARAMDKAELFLRQMVDDDIRPNGVTYNAMIHGYSTLGQWKKATQMFREMTSRGLVPDTVTWNSCMASLCKHGRSREAAELLYSMAAKGHKPNVVSYSTLLHGYANEGCFADMVNLFNSMVGKGIVPDHHVFNIFINAYAKCGMMDEVMHMLTEMREQGMSPDVCTYATIIAALCRMGRLADAVDNFNQMIGKGVQPSKVVYRSLIQGFCTHGDLVKAKEFIFEMTDKCICRPTIVFFNSIMHSLRNEGRVIDAHHIFDLVIDIGERPDLIAFNTLIDGYCLVGNMEKALGVLDSMVSAGIEPTVVTYSSLISGYCKSGRLDDGVILFREMEHKRVKPDTVAYNIILDGLFHAGATIAAKKLFNEMIESGTAVSISTYRIVLGGFCRNNCTDEAIVLFQKLGAMNVKFDIAILNTMINAMYKVQRREEANDLFASLPACGLVPNASTYGVVIQNLLKEGSLEEADNMFSSMEKSGCAPSSRLINYIIRTLLEKGEIVNAANYMSKVDGKIISFEASTTSLLLSLFSEKGKYQEQLQLLPAKYQFFGGVI

SEQ ID NO: 107 - protein, 716 aa, Triticum aestivum
MPRRSRQAGGAAHSLHLRHPDELLLPRASSGPRACLIWPPPKDRPQTNEIVASTVLKCLCCAKRTDEAVNVLIHRMSDLGCVPNEFSYKTVLKSLCEDSRSQRALDLLRVMAKGDGCSPCVVSYSTVIYGFFKEGKVGKACNLFHEMTQQGVVSDVVTYNSIIDALCKARAMDKAELFLRQMVDDDIRPNGVTYNAMIHGYSTLGQWKKATQMFREMTSRGLVPDTVTWNSCMASLCKHGRSREAAELLYSMAAKGHKPNVVSYSTLLHGYANEGCFADMVNLFNSMVGKGIVPDHHVFNIFINAYAKCGMMDEVMHMLTEMREQGMSPDVCTYATIIAALCRMGRLADAVDNFNQMIGKGVQPSKVVYRSLIQGFCTHGDLVKAKEFIFEMTDKCICRPTIVFFNSIMHSLCNEGRVIDAHHIFDLVIDIGERPDLIAFNTLIDGYCLVGNMEKALGVLDSMVSAGIEPTVVTYSSLISGYCKSGRLDDGVILFREMEHKRVKPDTVAYNIILDGLFHAGATIAAKKLFNEMIESGTAVSISTYRIVLGGFCRNNCTDEAIVLFQKLGAMNVKFDIAILNTMINAMYKVQRREEANDLFASLPACGLVPNASTYGVVIQNLLKEGSLEEADNMFSSMEKSGCAPSSRLINYIIRTLLEKGEIVNAANYMSKVDGKIISFEASTTSLLLSLFSEKGKYQEQLQLLPAKYQFFGGVI

SEQ ID NO: 108 - protein, 789 aa, Triticum aestivum; identical to SEQ ID NO: 106

SEQ ID NO: 109 - protein, 789 aa, Triticum aestivum
MVSPRRLCRGHGARPCRDAQPGGRTPPVRPIATAGHSGPRALPGRLPCRPRPCARLSCLQRWPRPRHRPLQPRMPRRSRPAGGAAHSLHLRHPDELLLPRASSGPRACLIWPPPKDRPQTNEIVASTVLKCLCCAKRTDEAVNVLIHRMSDLGCVPNEFSYKTVLKSLCEDSRSQRALDLLRVMAKGDGCSPCVVSYSTVIYGFFKEGKVGKACNLFHEMTQQGVVSDVVTYNSIIDALCKARAMDKAELFLRQMVDDDIRPNGVTYNAMIHGYSTLGQWKKATQMFREMTSRGLVPDTVTWNSCMASLCKHGRSREAAELLYSMAAKGHKPNVVSYSTLLHGYANEGCFADMVNLFNSMVGKGIVPDHHVFNIFINAYAKCGMMDEVMHMLTEMREQGMSPDVCTYATIIAALCRMGRLADAVDNFNQMIGKGVQPSKVVYRSLIQGFCTHGDLVKAKEFIFEMTDKCICRPTIVFFNSIMHSLRNEGRVIDAHHIFDLVIDIGERPDLIAFNTLIDGYCLVGNMEKALGVLDSMVSAGIEPTVVTYSSLISGYCKSGRLDDGVILFREMEHKRVKPDTVAYNIILDGLFHAGATIAAKKLFNEMIESGTAVSISTYRIVLGGFCRNNCTDEAIVLFQKLGAMNVKFDIAILNTMINAMYKVQRREEANDLFASLPACGLVPNASTYGVVIQNLLKEGSLEEADNMFSSMEKSGCAPSSRLINYIIRTLLEKGEIVNAANYMSKVDGKIISFEASTTSLLLSLFSEKGKYQEQLQLLPAKYQFFGGVI

SEQ ID NO: 110 - protein, 390 aa, Triticum aestivum
MSPDVCTYATIIAALCRMGRLADAVDNFNQMIRKGVQPSKVVYRSLIQGFCTHGDLVKAKEFIFEMTDKCICRPTIVFFNSIMHSLCNEGRVIDAHHIFDLVIDIGERPDLIAFNTLIDGYCLVGNMEKALGVLDSMVSAGIEPTVVTYSSLISGYCKSGRLDDGVILFREMEHKRVKPDTVAYNIILDGLFHAGATIAAKKLFNEMIESGTAVSISTYRIVLGGFCRNNCTDEAIVLFQKLGAMNVKFDITILNTMINAMCKVQRREEANDLFASLPACGLVPNASTYGVVIQNLLKEGSLEEADNMFSSMEKSGCAPSSRLINYIIRTLLEKGEIVNAANYMSKVDGKIISFEASTTSLLLSLFSEKGKYQEQLQLLPAKYQFFGGVI

SEQ ID NO: 111 - protein, 716 aa, Triticum aestivum; identical to SEQ ID NO: 107

SEQ ID NO: 112 - protein, 789 aa, Triticum aestivum; identical to SEQ ID NO: 106

SEQ ID NO: 113 - protein, 758 aa, Triticum aestivum
MPTARLSSIFTSSFKAPSRERRAPLAALAAATERVRAGTLSQEDAHHLFDELLSQAATVPVRGLNNFLAALARAPPGLLYRGAGARVVSPTCCTYSILMDCCCRAGRPDLVLAFFGRLLRLGLRFEEVIPFNNLLKGLCQAKRSNEALDMLLHRMPELDCAPDVFSFNIVINGCFKEGEVDKACNLFHEMPQLGVQPDVVTYTSIMDALSKSGAMDKAEVLLRQMVDQGIEPNIITYTSLIHGYSTSGQWKAAVRIFKEMASAGVRPNSVTLNSFIDSLCKHRKTKEARDIFDSMAAKGHKPDIFSYSTMLNWYAKEGCFDDMTDLFNSMVRNGIVPDHHVFNILINAYARRGLMDKAMHMFEVMRQQGVNPNVVDYVVVMDSLCKMGKMAAAMDIFNQMVNQGVSPNKAVYQCLVLGSCSHGHFVKAKELISEAVNRGLCSNSVFFYPVINDRCKEGKVKEAQDMFDFIVGIGHRPHVIMYNSLMDGYCLVGKVEEALRVLDAMKSAGLQPDLFTYGILINGYCKIGRIDEGLSLVREISLSGVKPTTIMYNIILDGLFCSGRTVPAKEKFHKMNESGIPVGVGTYNIVLSGLCKNNCTDEAIELFKKLRAVNVKINVITLTTMISAMFKTRRIEEAKDLFAAISAIGLVPSVVTYSITMTNFIKEGLLADADDMFSAMEKAGCAHNSRLLNQVVRVFLKNGEVVKAVTYLAKLDAKQLSVEASTVSLIVSLFSRKGKLREHVKLLPVKYQPPEMLD

SEQ ID NO: 114 - protein, 768 aa, Triticum aestivum
MPTARLSSISTSSFRAPSRAPLAALAAATERVRAGTLSREDAHHLFDELLGQAAPVPERGLNNFLAALARAPPSSAYSDGPGLAIALFNRMSRCAGARVVSPTLCTYSILMDCCCRAGCRELVVAFFGRLIKLGLRLNVIPFNNLLKGLCQAKRTNEAVDLLLHRTPELDCVPNVFSYSIVINGCFKQGEVDKACNLFHQMIQLGVQPNLVTYNSIIDALSKSGAMDKAEVVLRQMVDQGIGPNVMTYTSLIHGYSTSGQWKEAVRLFKKMIGLGALPDTVMWNSFMDSLCKHRRTKDARDIFDSMAAKGQKPDIFSYSIMLNGYAKEGYFEDMTDLFNLMVRNGIVPNHHVFNILINAYAKRGLMDEAMHMFEVMRQQGVNPNVDYLVIMDSLCKMGRMDAALDKFNQMVNQGVSPNKAVYQCLVLGSCSHGHFVKAKELISEAINRGLFSNSVFFYPVINDLCKEGKVKEAQDMFNFIVGIGQRPDVIMYNSLMDGYCLVGKVEEALRVLAAMKSAGLQPTAVTYGILLNGYCKSGRIAAGLSLFMEMSLSGVKPTTIMYNIILDGLFCSGRTVSAKEEFDTMIESGIPVNVRTYNIVLSGLCRNNCTGEAIELFKKLRAMNVKINVITLNTMISAMFKTRRIEEAKDLFATISAIGLVPSVVTYSVMMTNFIKEGLLAEADDMFLAMEKAGCAPDSRLLNHVVRVLLENGAVVKAVTYLTKLDAKQLSLEASTVSFIVSLFSRKGKLREHVKLLPVKYQPPEMLG

SEQ ID NO: 115 - protein, 831 aa, Triticum aestivum
MSSIHLRHCSTMPMSRVCLRRRLSSSSSFSNCTSPPSPTWSPHAAFAAATERVRAGTLSPQDAHHLFDVLFQQAIRVPERSLDGFLAALSHATSSEACRDGPALALTLFNRVCREEAGMRVALPTIFTYGILMNCCCRVRRPDLGLAFFGCILRAGLKTNQIAANTVIKCLCCAKHTDEAVNMLLHRMSDLGCVPDAFSYNTILKSLCEDGRSLQALDLLLQMVSKEGGACSPDMVAYSTVIHGFLKEGKVDKACNLFNEMMRQGVVPDVVTYSSIIDALCKAGAMHKAELFLRQMVDNGVRPDEVTYTSMIHGYSTLGRLKEVRKMFREMTSCGLIPDIVTWNSFMDSLCKHGRTKEAAKVFFSMAAKGNKPNIVSYTILLHGYANEGSFADMMSLFNSMKGGGIVANCKVFNILIGAYAKRGLIDEAMLILTEMRGQGLSPDVVTYSTLISAHWRMGKLTDAMDNFSQMVVGTGVQPDTVFYHSLVQFLCTHGDLVKAKELISEMMNKGIARPNTALFSSIMDSLCNEGRVIDAHHIFDLVIDIGEKPDISMFSTLIDGYCLVGEMDKACGVLDAMVSAGIEPNVITYSTLVSRYCKRGRIDDGLILFRQMLHKKVKPTTVTYETILNGLFRAGRTADAKKMFHEMIESGIMVSISAYNIILGGLCRNNCADEAIVLFQKLRAMNVKFNITTLNTIINALYKVERREEANDLFAALPASGLVPNASTYGVMVQNLLKEGAVEEADSMFSSMEKSGCAPSSRLINDVIRTLLEKGEIVKAGKYMSKVDGKSISLQASTSSLLLSLFSGNGKYREQLQLLPAKYQFFNGIS

SEQ ID NO: 116 - protein, 831 aa, Triticum aestivum; identical to SEQ ID NO: 115

SEQ ID NO: 117 - protein, 831 aa, Triticum aestivum; identical to SEQ ID NO: 115

SEQ ID NO: 118 - protein, 571 aa, Triticum aestivum
MMRQGVVPDVVTYSSIIDALCKAGAMHKAELFLRQMVDNGVRPDEVTYTSMIHGYSTLGRLKEVRKMFREMTSCGLIPDVVTWNSFMDSLCKHGRTKEAAKVFFSMAAKGNKPNIVSYTILLHGYANEGSFADMMSLFNSMKGGGIVANCKVFNILIGAYAKRGLIDEAMLILTEMRGQGLSPDVVTYSTLISAHWRMGKLTDAMDKFSQMVVGMGVQPDTVFYHSLVQFLCTHGDLVKAKELISEMMNKGIARPNTALFSSIMDSLCNEGRVIDAHHIFDLVIDIGEKPDISMFSTLIDGYCLVGEMDKACGVLDAMVSAGIEPNVITYSTLVSRYCKRGRIDDGLILFRQMLHKKVKPTTVTYETILNGLFRAGRTADAKKMFHEMIESGIMVSISAYNIILGGLCRNNCADEAIVLFQKLRAMYVKFNITTLNTIINALYKVERREEANDLFAALPASGLVPNASTYGVMVQNLLKEGAVEEADSMFSSMEKSGCAPSSRLINDVIRTLLEKGEIVKAGKYMSKVDGKSISLEASTSSLLLSLFSGNGKYREQLQLLPAKYQFFNGIS

SEQ ID NO: 119 - protein, 243 aa, Triticum aestivum
MSSIHLRHCSTMPMSRVCLRRRLSSSSFSNCTSPPSPTWSPHAAFAAATERVRAGTLSPQDAHHLFDVLFQQAIRVPERSLDGFLAALSHATSSEACRDGPALALTLFNRVCREEAGMRVAPHTIFTYGILMNCCCRVRRPDLGLAFFGRILRAGLKTNQIAANTVIKCLCCAKHTDEAVNMLLHRMSDLGCVPDAFSYNTVLKSLCEDGRSLQALDLLLQMVAPPTWWLITRSSMASLRKVK

SEQ ID NO: 120 - protein, 243 aa, Triticum aestivum; identical to SEQ ID NO: 119

SEQ ID NO: 121 - protein, 571 aa, Triticum aestivum; identical to SEQ ID NO: 118

SEQ ID NO: 122 - protein, 571 aa, Triticum aestivum; identical to SEQ ID NO: 118

SEQ ID NO: 123 - protein, 243 aa, Triticum aestivum; identical to SEQ ID NO: 119

SEQ ID NO: 124 - protein, 758 aa, Triticum aestivum
MPTARLSSIFTSSFKAPSRERRAPLAALAAATERVRAGTLSQEDAHHLFDELLSQAATVPVRGLNNFLAALARAPPGLLYRGAGARVVSPTCCTYSILMDCCCRAGRPDLVLAFFGRLLRLGLRFEEVIPFNNLLKGLCQAKRSNEALDMLLHRMPELDCAPDVFSFNIVINGCFKEGEVDKACNLFHEMPQLGVQPDVVTYTSIMDALSKSGAMDKAEVLLRQMVDQGIEPNIRTYSCLIHGYSTFGQWKEALRVFKEMASLGVVPDVVTLSSLIDSLCRHRRTKQAREIFDSMAAKGLKPNIVSYSTMLNGYVKEGSFEDMTGLFNSMVRNGIVPNHHIFNILINAYAKRGLMDEAMHMFEVMRQQGVNPDVFGYQIIMDSLCKMGKMDAALDKFNQMVNQGVSPNKAVYQCLVLGSCSHGDFVKAKELISEAVNRGLCSNSVFFYPVINDRCKEGKVKDAQDMFDFIVGIGHRPDVIMYNSLMDGYCLVGKVEEALRVLDAMKSAGLQPDVFTYGILINGYCKIGRIDDGLSLVREISLSGVKPTTIMYNIILDGLFCSGRTVPAKEKFHKMNESGIPVGVGTYNIVLSGLCKNNCTDEAIELFKKLRAVNVKINVITLTTMVSAMFKTRRIEEAKDLFVTISAIGLVPSVVTYSIMMTNFIKEGLLADADDMFSAMEKAGCAHNSRLLNQVVRVFLKNGEVVKAVTYLAKFDAKQLSVEASTVSLIVSLFSRKGKLREHVKLLPVKYQPPEMLD

SEQ ID NO: 125 - protein, 758 aa, Triticum aestivum; identical to SEQ ID NO: 124

SEQ ID NO: 126 - protein, 374 aa, Triticum aestivum
MGKLTDAMDKFSQMVVGTGVQPDTVVYHSLVQFLCTHGDLVKAKELISEMMNKSIARPNTALFSSIMDSLCNEGRVIDAHHIFDLVIDIGEKPDISMFSTLIDGYCLVGEMDKACGVLDAMVSAGIEPNVITYSTLVSRYCKRGRIDDGLILFRQMLHKKVKPTTVTYETTLNGLFRAGRTADAKKIFDEMIESGIMASISTYNIILGGLCRNNCADEAVVLFQKLRAMNVKFNITTLNTIINALYKVERREEANDLFAALPVSGLVPNASTYGVMVQNLLKEGAVEEADSMFSSMEKSGCAPSSRLVNDVIRTLLEKGEIVKAGKYMSKVDGKSISLEASTSSLLLSLFSGNGKYREQLQLLPAKYQFFDGIS

SEQ ID NO: 127 - protein, 828 aa, Triticum aestivum
MSSIHLRHCSTMPMSRVCLRRRLSSFSNCTSPPSPTWSPHAAFAAATERVRAGTLSPQDAHHLFDELFRQATPVPERSLDGFLAALGRATPSEACRDGPSLALTLFNRVCREEAGMRVAPPTIFTYGILMNCCCRMGRPDLGLAYFGRILRAGLKANQIAANTVIKCLCCAKHTDEAVNMLLHRMSDLGCVPDAFSYNTVLKSLCEDGRSLQALDLLLQMASKEGGACSPDMVAYSTVIHGFLKEGKVDKACNLFDEMMRQGVVPDVVTYSSIIDALCKAGAMYKAELFLRQMVDDGVRPDEVTYTSMIHGYSTLGRWKQVRKMFREMTSRGLIPDTVTWNSFMDSLCKHGRTKEAAEVFFSMAGKGSKPNIVSYTILLHGYANEGSFADMMSLFNSMKGGGIVANCKVFNILIGAYAKRGLIDEAMLILTEMRGQGLSPDVVTYSTLISAHWRMGKLTDAMDKFSQMVVGTGVQPDTVVYHSLVQFLCTHGDLVKAKELISEMMNKSIARPNTALFSSIMDSLCNEGRVIDAHHIFDLVIDIGEKPDISMFSTLIDGYCLVGEMDKACGVLDAMVSAGIEPNVITYSTLVSRYCKRGRIDDGLILFRQMLHKKVKPTTVTYETILNGLFRAGRTADAKKIFDEMIESGIMVSISTYNIILGGLCRNNCADEAVVLFQKLRAMNVKFNITTLNTIINALYKVERREEANDLFAALPVSGLVPNASTYGVMVQNLLKEGAVEEADSMFSSMEKSGCAPSSRLVNDVIRTLLEKGEIVKAGKYMSKVDGKSISLEASTSSLLLSLFSGNGKYREQLQLLPAKYQFFDGIS

SEQ ID NO: 128 - protein, 374 aa, Triticum aestivum; identical to SEQ ID NO: 126

SEQ ID NO: 129 - protein, 828 aa, Triticum aestivum; identical to SEQ ID NO: 127

SEQ ID NO: 130 - protein, 337 aa, Triticum aestivum
MRVAPPTIFTYGILMNCCCRMGRPDLGLAYFGRILRAGLKANQIAANTVIKCLCCAKHTDEAVNMLLHRMSDLGCVPDAFSYNTVLKSLCEDGRSLQALDLLLQMASKEGGACSPDMVAYSTVIHGFLKEGKVDKACNLFDEMMRQGVVPDVVTYSSIIDALCKAGAMYKAELFLRQMVDDGVRPDEVTYTSMIHGYSTLGRWKQVRKMFREMTSRGLIPDTVTWNSFMDSLCKHGRTKEAAEVFFSMAGKGSKPNIVSYTILLHGYANEGSFADMMSLFNSMKGGGIVANCKVFNILIGAYAKRGLIDEAMLILTEMRGQGLSPDVVTYSTLISAH

SEQ ID NO: 131 - protein, 337 aa, Triticum aestivum; identical to SEQ ID NO: 130

SEQ ID NO: 132 - protein, 828 aa, Triticum aestivum; identical to SEQ ID NO: 127

SEQ ID NO: 133 - protein, 828 aa, Triticum aestivum; identical to SEQ ID NO: 127

SEQ ID NO: 134 - protein, 813 aa, Triticum aestivum
MSRLHLLRRRCSTSISTSPPSRSWSPRAAFAAATERVRAGTLSPEDAHHLFDQLLRQSTPVPERSLNGFLAALVRTPASESCRDGPSLALALFNRVCREEAGLRVAPPTIFTYNILMNCCCLARRPDLGLAFFGRLLRTGLKTNQSFANTLLKCLCCAKQTDEAVSVLLHRMSDLGCVPDDFSYNTVLKSLCEDSRSRRALDLLQMMAKEGGVCSPDVVTYNTVIHGFFKEGEIGKACNLFHEMMQQGVVPNVVTYNSIIDALCKARAMDNAELFLRMMVDNGVPPDKVTYTSMIHGYSTLGRWKEATKKFREMTSRGLIPGIITWNSFMDSLCKHGRSKEVAEIFHSMSAKGHKPDIISYTTLLHGYANEGSFPDMMSLFKSMEGNGIVANCQVFNILIDAYAKRGMMDEAMLIFTEMLGQGVNPSVITYSIVIAALCRMGRLADAMDTFSQMISVGMKPDTVVYHSLIQGFSTHGDLVKAKELIYEMMNNGIPRPNSVFFSSIVNSLCKEGRVVDAHHIFDLVKDLGERPNIIMFTTLIDGYCLVGEMDKAFRVLDAMVLAGVEPDVVTYSTLVNGYCSNGRIDDGLILFREMLHKKVKPTTVTYNIILDRLFRAGRTVAAKKMLHEMIGSGTPVSMHTYGIFLRGLCRNDCTDEAIALFQKLGALNVNFDITILNSMINAMYRVQRREEANKLFAAISTSGLVPNASTYGIMIRNLLKEGSVEEAEDMFSSMEESDCALSSRLINDIIRTLLEKGDIVKAGKYMSKVDETSISLEASTSSLLLSLFSGKGKCREQIELLPAKYQIFDGIS

SEQ ID NO: 135 - protein, 813 aa, Triticum aestivum
MSRLHLLRRRCSTSISTSPPSRSWSPRAAFAAATERVRAGTLSPEDAHHLFDQFLRQSTPVPERSLNGFLAALVRTPASESCRDGPSLALALFNRVCREEAGLRVAPPTIFTYNILMNCCCLARRPDLGLAFFGRLLRTGLKTNQSFANTLLKCLCCAKQTDEAVSVLLHRMSDLGCVPDDFSYNTVLKSLCEDSRSRRALDLLQMMAKEGGVCSPDVVTYNTVIHGFFKEGEIGKACNLFHEMMQQGVVPNVVTYNSIIDALCKARAMDNAELFLRMMVDNGVPPDKVTYTSMIHGYSTLGGWKEATKKFREMTSRGLIPGIITWNSFMDSLCKHGRSKEAAEIFHSMSAKGHKPDIISYTTLLHGYANEGSFPDMMSLFKSMEGNGIVANCQVFNILIDAYAKRGMMDEAMLIFTEMLGQGVNPSVITYSIVIAALCRMGRLADAMDTFSQMISVGMKPDTVVYHSLIQGFSTHGDLVKAKELIYEMMNNGIPRPNSVFFSSIVNSLCKEGRVVDAHHIFDLVKDLGERPNIIMFTTLIDGYCLVGEMDKAFRVLDAMVLAGVEPDVVTYSTLVNGYCSNGRIDDGLILFREMLHKKVKPTTVTYNIILDRLFRAGRTVAAKKMLHEMIGSGTPVSMHTYGIFLRGLCRNDCTDEAIALFQKLGALNVNFDITILNSMINAMYRVQRREEANKLFAAISTSGLVPNASTYGIMIRNLLKEGSVEEAEDMFSSMEESDCALSSRLINDIIRTLLEKGDIVKAGKYMSKVDETSISLEASTSSLLLSLFSGKGKCREQIELLPAKYQIFDGIS

SEQ ID NO: 136 - protein, 813 aa, Triticum aestivum; identical to SEQ ID NO: 134

SEQ ID NO: 137 - protein, 813 aa, Triticum aestivum; identical to SEQ ID NO: 135

SEQ ID NO: 138 - protein, 813 aa, Triticum aestivum; identical to SEQ ID NO: 134

SEQ ID NO: 139 - protein, 813 aa, Triticum aestivum; identical to SEQ ID NO: 135

SEQ ID NO: 140 - protein, 703 aa, Triticum aestivum
MPAARLSSFKAPSRERRPPLAALAAATERVRAGTLSRQDAHHLFDELLSQAATVPVRKLNNFLAALARAPPSAACSDGPDLAIALFNRMSRGAGARVVSPTLSTYSILMDCCCRARRPELVVAFFGRLLRLGLRLDIISSSNLLKGLCQAKRSNEALDMLLHRMPELDCAPDVFSFNIVINGCFKEGEVDKACNLFHEMPQLGVQPDVVTYTSIMDALSKSGAMDKAEVLLRQMVDQGIEPNIKTYNCLIHGYSTFGQWKAAVRVFKEMASVGVQPNAVTLNSLIDSLCKHRRTKEAREILDSMAAKGLKPNIVSYSTMLNGYVKEGCFDDMTDLFNSMVRNGIVPNHHIFNILINAYAKRGVMDEAMHMFEVMRQQGVNPDVFSYQIVMDSLCKMGRMDAALDKFNQMVNQGVSPNKAVYQCLVLGSCSHGHFVKAKELISEVVNRGLCSNSVFFYPVINGLCKEGKVKEAQDMFDFILGIGQRPDVIMYTSLMDGYCLVGEVEKALSVLDAMKSAGLQPDDVVYATLLNGYCKIGRIADGLSLFREMSLSGVKPMTIIYNIILDGLFCSGRTVCAKEKFNTMTESGIPVGVDTYNILPLERFIRRFRKCSSNLGTLRKFGRFHFCPCAHSLTRTHPFPSRTHSPASTSPCPNPARWRRSSLSPASTPPPRPLRSLPSPLVAASPSPRPRCLAKIVFLVRSG

SEQ ID NO: 141 - protein, 703 aa, Triticum aestivum; identical to SEQ ID NO: 140

SEQ ID NO: 142 - protein, 275 aa, Triticum aestivum
MPRRSRPAGGILMGCFCGAHRPDLGLALFGRFLGTGLKTNKIVATTFLKCLCYAKRTDEAVNLLLRRMPELGCVPDAISYTIVLKSLCENSMSQRALDLLQMVAEGGGACSLNVVVYSTVIHGFFKEGETGKACNLFHEMIHQGVVPNVVTYSSIIDALCKARAMDKAELVLQQMVDSGAQPNNVTYNCMIHGYSTSGQLKEAAKMFRKMTSHGLVPNAVTCSSLMTSLCKHGRSKEAAEIFYSMTAKGHKPDAVSYRILLHGYANEGCFADMID

SEQ ID NO: 143 - protein, 275 aa, Triticum aestivum; identical to SEQ ID NO: 142

SEQ ID NO: 144 - protein, 807 aa, Triticum aestivum
MPAARLSSISTSSFKAPSREGRAPLAALAAATERVLAGTLSRQDAHHLFDELLSQAAAVPERGLNNSLAALARTPPSAACSDGPGLAIALFNRMSRGAGALVASSTLCTYSILMDCCCRAGRPDLVVAFFGRLLRLGLRLNVISFNNLLKGLCQAKRSNEALDLLLHRMPELDCAPDVFSFNIVINGCFREGEVDKACNLFHEMPQLGVQPDVVIYNSIIDTLSKSGAMDKAEVVLRQMVDKGIGPDVMTYNSLIHGYSTLGQWKAAVRVFKEMVSVGVLPNAVTLNSFMDSLCKHRRTKEARDIFDSMAAKGHKPNIASYSTMLNGYAKQGCFDDMTGLFNSMVQNGIVPNNHVFNILIRAYSTRGLMDKAMHMFEVMKQQGVNPNVVDYLVIMDSLCKMGRMDAALDKFNQMVNQGVSPDKVVYRCLVLGSCSHGHFVKAKELISKAVNRGLCSNSEFFYPVINDLCKEGKVKEAQDMFDFIVGIGQRPDVIMYNSLMDGYCLVGKVEEAVRVLDAMKSAGLQPTAVTYAILLNGYCKIGRIAAGLSLFMEMSLSGVKPTTIMYNIIPDGLFCSGRTVSAKEKFNTMIESGIPVGVDTYNIVLHGLCRNNCTDEAIDLFKKLCARNVKIDVITFNTVISAMFKTRRIEEAKDLFATIPAIGLVPSVVTYSLMMTNFIKEGSLAEADDMFLAMEKDGCAPDSRLLNQVVRVLLEKGAVVQAATYLAKLDAKQMSLEVSTISLIVYLFSRKGKLREHVKLLPMSTSLRRCPTDVTWWYSLIADRMSLPPPAVFENADNSSILLLPDV

SEQ ID NO: 145 - protein, 406 aa, Triticum aestivum
MDCCCRARRPDLGLALFGRFLRTGLKTNEIIANTFLKCLCYAKRTNEAINLLLHRMPELGCVPDAFSYNIVLKSLCENSMSQRALDLLQMVAEGGGACSLNVVAYSTVIHGFFKEGETGKACNLFHEMIHQGVVPNVVTYSSIIDALCKAREMDKAELVLQQMVDSGAQPNNVTYNCMIHGYSTSGQLKEAAKMFRKMTSHGLVPNAVTCSSLMTSLCKHGRSKEAAEIFYSMTAKGHKPDAVSYRILLHGYATEGCFADMIDLFNSMESNGFVADCHVFTILIDAYAKRGMMDEAMLIFTEMQEKGVSPNVVTYSTVIAALCRLGRLADAMDKFNEMIDMGVQPGTTVYHSLIQGFCMHVDLVKAKELVSDMISKGIPRPNIVFLQFSYKLFVQRRTGYGCTRYL

SEQ ID NO: 146 - protein, 298 aa, Triticum aestivum
MDAQDIFELVISIDGKPDVITFNSLIDGYCLVGKMDKAFGVLDAMVSAGIEPNVVTYNTLVNGYSRNGRIDDGLTLFRQMPRKRIKPDSATYGIILDGLFRAGRTVAARKMFHEMIESGITVSISTYNIILAGLSRNNCAEEAIDLYQKLVAMNVKFNISIINTMINAMYKVKRKEEAKDLFAAISASGLVPNASTYGVMIINILKDGAVEDANNMFSAMDRNGIAPCSRLINSIIRILLEKGEITMAGLYLSKLDGKNMLLEASTTSLMLSLFSRKGKYKEDVKFLPAKYQFFDGFG

SEQ ID NO: 147 - protein, 824 aa, Triticum aestivum
MSRLRLRRSSTTPMFHLLRRSSSSTSISPPSRSWSPEGAFAAATARVSAGTLSPEEAHHLFDELLRQGTPVPSRSLNGFLATLARAPASAAYSRDGPALALALFNRVCTEKAGSRVAHLTVHTYGILMDCCCRARRPDLGLALFGRFLRTGLKTNEIIANTFLKCLCYAKRTNEAINLLLHRMPELGCVPDAFSYNIVLKSLCENSMSQRALDLLQMVAEGGGACSLNVVAYSTVIHGFFKEGETGKACNLFHEMIHQGVVPNVVTYSSIIDALCKARAMDKAELVLQQMVDSGAQPNNVTYNCMIHGYSTSGQLKEAAKMFRKMTSHGLVPNAVTCSSLMTSLCKHGRSKEAAEIFYSMTAKGHKPDAVSYRILLHGYATEGCFADMIDLFNSMESNGFVADCHVFTILIDAYAKRGMMDEAMLIFTEMQEKGVSPNVVTYSTVIAALCRLGRLADAMDKFNEMIDMGVQPGTTVYHSLIQGFCMHVDLVKAKELVSDMISKGIPRPNIVFFNSVINYLCKEGRVMDAQDIFELVISIDGKPDVITFNSLIDGYCLVGKMDKAFGVLDAMVSAGIEPNVVTYNTLVNGYSRNGRIDDGLTLFRQMPRKRIKPDSATYGIILDGLFRAGRTVAARKMFHEMIESGITVSISTYNIILAGLSRNNCAEEAIDLYQKLVAMNVKFNISIINTMINAMYKVKRKEEAKDLFAAISASGLVPNASTYGVMIINILKDGAVEDANNMFSAMDRNGIAPCSRLINSIIRILLEKGEITMAGLYLSKLDGKNMLLEASTTSLMLSLFSRKGKYKEDVKFLPAKYQFFDGFG

SEQ ID NO: 148 - protein, 298 aa, Triticum aestivum; identical to SEQ ID NO: 146

SEQ ID NO: 149 - protein, 406 aa, Triticum aestivum; identical to SEQ ID NO: 145

SEQ ID NO: 150 - protein, 824 aa, Triticum aestivum; identical to SEQ ID NO: 147

SEQ ID NO: 151 - protein, 298 aa, Triticum aestivum; identical to SEQ ID NO: 146

SEQ ID NO: 152 - protein, 298 aa, Triticum aestivum; identical to SEQ ID NO: 146

SEQ ID NO: 153 - protein, 406 aa, Triticum aestivum; identical to SEQ ID NO: 145

SEQ ID NO: 154 - protein, 406 aa, Triticum aestivum; identical to SEQ ID NO: 145

SEQ ID NO: 155 - protein, 535 aa, Triticum aestivum
MMVLDLNVTYSSLIHGYSSSGHWKEAVRVFKEMTSRRVTADVHTYNMFMTFLCKHGRSKEAAGIFDTMAIKGLKPDNVSYAILLHGYAAEGCLVDMINLFNSMERDCILPDCRIFNILINAYAKSGKLDKAMLIFNEMQKQGVSPNAVTYSTVIHAFCKKGRLDDAVIKFNQMIDTGVRPDASVYRPLIQGFCTHGDLVKAKEYVTEMMKKGMPPPDIMFFSSIMQNLCTEGRVTEARDILDLIVHIGMRPNVIIFNLLIGGYCLVRKMADALKVFDDMVSYGLEPCNFTYGILINGYCKNRRIDDGLILFKEMLHKGLKPTTFNYNVILDGLFLAGQTVAAKEKFDEMVESGVSVCIDTYSIILGGLCRNSCSSEAITLFRKLSAMNVKFDITIVNIIIGALYRVERNQEAKDLFAAMPANGLVPNAVTYTVMMTNLIKEGSVEEADNLFLSMEKSGCTANSCLLNHIIRRLLEKGEIVKAGNYMSKVDAKSYSLEAKTVSLLISLFSRKGKYREHIKLLPTKYQFLEEAATVE

SEQ ID NO: 156 - protein, 788 aa, Triticum aestivum
MPRFSSTTPMSPPRLRLRLCARHSSSTSHPSRIWDPHAAFAAAAQRASSGTLTTEDAHHLFDELLRRGNPVQERPLNKFLAALARAPASASCCDGPALAVALFGRLSRDVGRRVAQPNVFTYGVLMDCCCRACRTDLVLAFFGRLLKTGLEANQVVFNTLLKGLCHTKRADEALDVLLHRMPELGCTPNVVAYNTVIHGFFKEGHVSKACNLFHEMAQQGVKPNVVTYNSVIDALCKARAMDKAEVVLRQMIDDGVGPDNVTYSSLIHGYSSSGHWKEAVRVFKEMTSRRVTADVHTYNMFMTFLCKHGRSKEAAGIFDTMAIKGLKPDNVSYAILLHGYAAEGCLVDMINLFNSMERDCILPDCRIFNILINAYAKSGKLDKAMLIFNEMQKQGVSPNAVTYSTVIHAFCKKGRLDDAVIKFNQMIDTGVRPDASVYRPLIQGFCTHGDLVKAKEYVTEMMKKGMPPPDIMFFSSIMQNLCTEGRVTEARDILDLIVHIGMRPNVIIFNLLIGGYCLVRKMADALKVFDDMVSYGLEPCNFTYGILINGYCKNRRIDDGLILFKEMLHKGLKPTTFNYNVILDGLFLAGQTVAAKEKFDEMVESGVSVCIDTYSIILGGLCRNSCSSEAITLFRKLSAMNVKFDITIVNIIIGALYRVERNQEAKDLFAAMPANGLVPNAVTYTVMMTNLIKEGSVEEADNLFLSMEKSGCTANSCLLNHIIRRLLEKGEIVKAGNYMSKVDAKSYSLEAKTVSLLISLFSRKGKYREHIKLLPTKYQFLEEAATVE

SEQ ID NO: 157 - protein, 258 aa, Triticum aestivum
MPRFSSTTPMSPPRLRLRLCARHSSCTSHPSRIWDPHAAFAAAAQRASSGTLTTEDAHHLFDELLRRGNPVQERPLNKFLAALARAPASASCCDGPALAVALFGRLSQDVRRRVAQPNVFTYGVLMDCCCRACRTDLALAFFGRLLKTGLEANQVVFNTLLKGLCHTKRADEALDVLLHRMPELGCTPDVVAYNTVIHGFFKEGHVSKACNLFHEMAQQGVKPNVVTYNSVIDALCKARAMDKAEVVLRQMIDDGVGP

SEQ ID NO: 158 - protein, 788 aa, Triticum aestivum; identical to SEQ ID NO: 156

SEQ ID NO: 159 - protein, 542 aa, Triticum aestivum
MPTGRLSSIFTSNATSSFRAPSPQPRAPLAALAAATERVRAGTLSRQDAHHLFDELLSQAATVPVRTLNNFLAALARAPPSAACGDGPALAIALFNRMSQGAGARVVSPTLCTYSILMDCCCRAGRPDLVVAFFGRLIRLGLRLNVIPFNNLLKGLCKAKRSNEALDLLLHRMPELDCAPDVFSYSIVINGCFKEGEVDKACNLFHGMIQLGVQPNVVIYTSIIDALSKCGAMDKAEVVFRQMVDKGIGPDVMTCTSLIHGYSISGRWKAAVRVFKEMISLGVVPDTVMWNSFVDSLCKHRRTKEARVIFDSMAAKGQKPDTVSYSIMLNGYVKEGCFDDMTGLFNSMLQNGVVPNHHIFNILINAYAKRGLMDEAMHMFEVMRQQGVNPDVVDYLVVMDSLCKMGRMDAALDKFNQMVNQGVSPNKAVYQCLVLGSCSHGDFVKAKELISEALNRGLCSNSVFFYPVINDLCKEGKVKEAQDMFDFIVGIGQRPDVIMYNSLMDGYCLVGKVEEALRVLDAMKSAGLQPDAIMYGILLNDH

SEQ ID NO: 160 - protein, 776 aa, Triticum aestivum
MPTGRLSSIFTSNATSSFRAPSPQPRAPLAALAAATERVRAGTLSRQDAHHLFDELLSQAATVPVRTLNNFLAALARAPPSAACGDGPALAIALFNRMSQGAGARVVSPTLCTYSILMDCCCRAGRPDLVVAFFGRLIRLGLRLNVIPFNNLLKGLCKAKRSNEALDLLLHRMPELDCAPDVFSYSIVINGCFKEGEVDKACNLFHGMIQLGVQPNVVIYTSIIDALSKCGAMDKAEVVFRQMVDKGIGPDVMTCTSLIHGYSISGRWKAAVRVFKEMISLGVVPDTVMWNSFVDSLCKHRRTKEARVIFDSMAAKGQKPDTVSYSIMLNGYVKEGCFDDMTGLFNSMLQNGVVPNHHIFNILINAYAKRGLMDEAMHMFEVMRQQGVNPDVVDYLVVMDSLCKMGRMDAALDKFNQMVNQGVSPNKAVYQCLVLGFCSHGDFVKAKELISETINRGLCSNNVFFYPVINDLCKEGKVKEAQDMFDFIVGIGQRPDVIMYNSLMDGYCLVGKVEEALRVLDAMKSAGLQPDAITYAILLNGYCKIGRIADGLSLFREMSLSGVKPTTIMYSIILDGLFRSGRTVSAKEKFNTMVESGLPVDVRTYNIVLHGLCRNNCTGEAIELFKKLCATNVKINVITFNTMISAMFKTRRIGEAKDLFATISAIGLVPSVVTYSVMTTNFIKEGLLAEADDMFLAMEKAGCAPNSRLLNHVVRVLLENGAVVKAATYLAKLDAKQLSLEASTVSLIVSLFSRKGKLREHVKLLPVKYQPPEMLD

SEQ ID NO: 161 - protein, 669 aa, Triticum aestivum
  misc_feature (28)..(28): Xaa can be any naturally occurring amino acid
MHQGVGCTDPSGRGQNPRPSATSHPSLXVHSLDSSAASQAARRRPGPPEFLSLLSLRRRHASSSSPLLRASVATPRRRRAVPPSAWLVPSIAGDATRARCGGARTVSLPGGQDPRQLRAELRWRRPAMPTGRLSSIFTSNATSSFRAPSPQPRAPLAALAAATERVRAGTLSRQDAHHLFDELLSQAATVPVRTLNNFLAALARAPPSAACGDGPALAIALFNRMSQGAGARVVSPTLCTYSILMDCCCRAGRPDLVVAFFGRLIRLGLRLNVIPFNNLLKGLCKAKRSNEALDLLLHRMPELDCAPDVFSYSIVINGCFKEGEVDKACNLFHGMIQLGVQPNVVIYTSIIDALSKCGAMDKAEVVFRQMVDKGIGPDVMTCTSLIHGYSISGRWKAAVRVFKEMISLGVVPDTVMWNSFVDSLCKHRRTKEARVIFDSMAAKGQKPDTVSYSIMLNGYVKEGCFDDMTGLFNSMLQNGVVPNHHIFNILINAYAKRGLMDEAMHMFEVMRQQGVNPDVVDYLVVMDSLCKMGRMDAALDKFNQMVNQGVSPNKAVYQCLVLGSCSHGDFVKAKELISEALNRGLCSNSVFFYPVINDLCKEGKVKEAQDMFDFIVGIGQRPDVIMYNSLMDGYCLVGKVEEALRVLDAMKSAGLQPDAIMYGILLNDH

SEQ ID NO: 162 - protein, 739 aa, Triticum aestivum
MPSEACRDGPFLALTLFNRVCREEAGMRVAPPTIFTYGILMNCCCRMGRPDLGLAYFGRILRAGLKANQIAANTVIKCLCCAKHSDEAVNMLLHRMSDLGCVPDAFSYNTVLKSLCEDGRSLQALDLLLQMASKEGGACSPDMVAYSTVIHGFLKEGKVDKACNLFDEMMRQGVVPDVVTYSSIIDALCKAGAMYKAELFLWQMVDDGVRPDEVTYTSMIHGYSTLGRWKQVRKMFREMTSRGLIPDTVTWNSFMDSLCKHGRTKEAAEVFFSMAGKGSKPNIVSYTILLHGYANEGSFADMMSLFNSMKGGGIVANCKVFNILIGAYAKRGLIDEAMLILTEMRGQGLSPDVVTYSTLISAHWRMGKLTDAMDKFSQMVVGTGVQPDTVVYHSLVQFLCTHGDLVKAKELISEMMNKSIARPNTALFSSIMDSLCNEGRVIDAHHIFDLVIDIGEKPDISMFSTLIDGYCLVGEMDKACGVLDAMVSAGIEPNVITYSTLVSRYCKRGRIDDGLILFRQMLHKKVKPTTVTYETTLNGLFRAGRTADAKKIFDEMIESGIMVSISTYNIILGGLCRNNCADEAIILFQKLRAMNVKFNITTLNTIIDALYKVERREEANDLFAALPASGLVPNASTYGVMVQNLLKEGAVEEADSMFSSMEKSGCAPSSRLVNDVIRTLLEKGEIVKAGKYMSKVDEKSISLEASTSSLLLSLFSGNGKYREQLQLLPAKYQFFDGIS

SEQ ID NO: 163 - protein, 825 aa, Triticum aestivum
MSRLRLRHCSCFTTPMSRIRLRRRLSSSTSRPTPSRSPRAAFAAATERVRAGTLSPQDAHHLFDELFQQATPVPERPLNGFLAALTRATPSEACRDGPALALSLFNRVCREEAGMRVAPPTIFTYGVLMNCCCRMRRPELGLAFFGRLLRTGLKADKIVANTVLKCLCCAKRADDAVKVLLHRMTELGCVPDAFSYAIVLKSLCDDNRSQQALYLLRMMAKEEGVCSPDVVTYNTVIHGFFKEGKIGKACNLFHEMTKQGFVPNVVTYNSVINALCKARAMDNAELFLRQMVDNGVQPNKVTYTSMIHGYSTLGQWKEATKLFREMTSSGLIPDIVTWNSFIDSLCKHGRSKEAAEIFHSMSAKGHKPDIISYTTLLHGYANEGSFPDMMSLFKSMEGDGIVANCQFFNILIDAYAKRGMMDEAMLIFTEMPGQGVNPNVVTYSTVVASLCRMGRLADAMNKFSEMIGTGVQPNTVVYHSLVQGLCTHGDLVKAKELISEMMNKGIPRPNIAFFSSIVHSLCKEGRVMDAHHIFDLVKDIGERSDIIMFNTLIDGYCLVGEMGKAVSVLDVMISAGIEPDIFTYNTLVNGYFKSGRIDDGLNLFREMSHKKIKPTTVTYNIILDGLFRAGRTVAAKKMLHELIGCGTTVSLSTYNIILKGLCRNNCTDEAIVMFQKLHTINVKFNITTLNTMINSMYTVQRREEAKNLFAAISDSGLVPNASTYGIMIRNLLKEGSVEEADSMFLSMERSGCAPCSRLLNDTIRTLLEKGEIVKAGNYMSKVDGKSISLEASTCSLLLSLFSGKGKYREQIQLLPVKYQFFGGVS

SEQ ID NO: 164 - protein, 825 aa, Triticum aestivum
MSRPRLRHCSCFTTPMSRIRFRRRLSSSTSRPTPSWSPRAAFAAATERVRDGTLSPQDAHHLFDELFQQATPVPDRPLNGFLAALTRATPSEACRDGPALALSLFNRVYREEAGMRVAPPTIFTYGVLMNCCCRMRRPELGLAFFGRLLRTGLKEDKIVANTVLKCLCCAKRADDAVKVLLHTMTELGCVPDAFSYAIVLKSLCDDNRSQQALYLLRMMAKEEGVCSPDVVTYNTVIHGFFKEGKIGKACNLFHEMTKQGFVPNVVTYNSVINALCKARAMDNAELFLRQMVDNGVQPNKVTYTSMIHGYSTLGQWKEATKLFREMTSSGLIPDIVTWNSFIDSLCKHGRSKEAAEIFHSMSAKGHKPDIISYTTLLHGYANEGSFPDMMSLFKSMEGDGTVANCQFFNILIDAYAKRGMMDEAMLIFTEMPGQGVNPNVVTYSTVIASLCRMGRLADAMNKFSEMIGTGVQPNTVVYHSLVQGLCTHGDLVKAKELISEMMNKGIPRPNIAFFSSIVHSLCKEGRVMDAHHIFDLVKDIGERSDIIMFNTLIDGYCLVGEMGKAVSVLDVMISAGIEPDIFTYNTLVNGYFKSGRIDDGLNLFREMSHKKIKPTTVTYNIILDGLFRAGRTVAAKKMLHELIGCGTTVSLSTYNIILKGLCRNNCTDEAIVMFQKLHTINVKFNITTLNTMINSMYTVQRREEAKDLFAAISDSGLVPNASTYGIMIRNLLKEGSVEEADSMFLSMERSGCAPCSRLLNDTIRTLLEKGEIVKAGNYMSKVDGKSISLEASTCSLLLSLFSGKGKYREQIQLLPVKYQFFGGVS

SEQ ID NO: 165 - protein, 825 aa, Triticum aestivum; identical to SEQ ID NO: 164

SEQ ID NO: 166 - protein, 825 aa, Triticum aestivum; identical to SEQ ID NO: 164

SEQ ID NO: 167 - protein, 825 aa, Triticum aestivum; identical to SEQ ID NO: 164

SEQ ID NO: 168 - protein, 825 aa, Triticum aestivum; identical to SEQ ID NO: 164

SEQ ID NO: 169 - protein, 825 aa, Triticum aestivum; identical to SEQ ID NO: 164

SEQ ID NO: 170 - protein, 697 aa, Triticum aestivum
MNCCRRTRRPELGLAFFGRVLRMGLRTNVVVATTVLQCLCGAKRTDEAVDILLHRMSELGCVPDAFSYSIVLKSLCDDGRSQRALDLLHMWEKERGLCSPNVVMYNTVIHGFFKEGEVSKACILFHEMEQKGVVPNVVTYSLTIDALCKARAMDKAQLFLRQMIDKGVRPNNVTYNVMIHGYCTLGQWKEARKMFREMTRQGLIPDIVTWTSFMASLCKHGRTKEAAEFFDSMTAKGHKPDLVMYHVLLHGYATKGCFADMINLFNSMATKGIVPDRQVFNILIDAHAKHGMMDEAMHIFTGMQGQGVCPDVWTYSTLISALCRMGRLADAMDNFSQMIGKGVQPNTVVYHSLIQGFSTHGDLRKAKELVYEMTNKGIPCPNIAFFSSVMDSICKEGRVMDAHDIFHLVTDIGLKPNIITFNTLIDGHCLAGEMEKAFGVLDSMVSAGIEADVFTYNTLAYGYCRCGRIDDGLILFREMLQNKPKPTTITYNIILDGLFRAGRTFAAKKMFVEMIETGITVSISTYSIILGGLCRNNCSDEAITLFQKLGTMNVKFDIKILNTMINAMFKVRRREETNGLFAAISASGMVPNASTYSVMIGNLLKEGSVEEAENMFSLMEKSGCAPDSRLINNIIRILLENGDIVKAGNYMSKVDGKSISLEASTTSLLMCLFSSKGKYREQISLLPVNYQFFNGVG

SEQ ID NO: 171 - protein, 824 aa, Triticum aestivum
MSRLRHSTSTAPMPHLRLLRCRSSSISTLPPSRSWSPVTAFAAATERVSAGTLSPEDAHRLFDELLRQATPVPARSLNGFLTALSRAPGTGACGDGPALALALFNRTRREEAGSRVVPSTIFTYGILMNCCRRTRRPELGLAFFGRVLRMGLRTNVVVATTVLQCLCGAKRTDEAVDILLHRMSELGCVPDAFSYSIVLKSLCDDGRSQRALDLLHMWEKERGLCSPNVVMYNTVIHDFFKEGEVSKACSLFHEMEQKGVVPNVVTYSLTIDALCKARAMDKAQLFLRQMIDKGVRPNNVTYNVMIHGYCTLGQWKEARKMFREMTRQGLIPDIVTWTSFMASLCKHGRTKEAAEFFDSMTAKGHKPDLVMYHVLLHGYATKGCFADMINLFNSMATKGIVPDRQVFNILIDAHAKHGMMDEAMHIFTGMQGQGVCPDVWTYSTLISALCRMGRLADAMDNFSQMIGKGVQPNTVVYHSLIQGFSTHGDLRKAKELVYEMTNKGIPCPNIAFFSSVMDGICKEGRVMDAHDIFHLVTDIGLKPNIITFNTLIDGHCLVGEMEKAFGVLDSMVSAGIEADVFTYNTLAYGYCRCGRIDDGLILFREMLQNKPKPTTITYNIILDGLFRAGRTFAAKKMFVEMIETGITVSISTYSIILGGLCRNNCSDEAITLFQKLGAMNVKFDIKILNTMINAMFKVRRREEANGLFAAISASGMVPNTSTYSVMIGNLLKEGSVEEAENMFSLMEKSGCAPDSRLINNIIRILLENGDIVKAGNYMSKVDGKSISLEASTTSLLMCLFSSKGKYREQISLLPVNYQFFNGVG

SEQ ID NO: 172 - protein, 824 aa, Triticum aestivum; identical to SEQ ID NO: 171

SEQ ID NO: 173 - protein, 824 aa, Triticum aestivum; identical to SEQ ID NO: 171

SEQ ID NO: 174 - protein, 836 aa, Triticum aestivum
MSRLRHSTSTAPMSRLRHSTSTAPMPHLRLLRCRSSSISTLPPSRSWSPVTAFAAATERVSAGTLSPEDAHRLFDELLRQATPVPARSLNGFLTALSRAPGTGACGDGPALALALFNRTRREEAGSRVVPSTIFTYGILMNCCRRTRRPELGLAFFGRVLRMGLRTNVVVATTVLQCLCGAKRTDEAVDILLHRMSELGCVPDAFSYSIVLKSLCDDGRSQRALDLLHMWEKERGLCSPNVVMYNTVIHDFFKEGEVSKACSLFHEMEQKGVVPNVVTYSLTIDALCKARAMDKAQLFLRQMIDKGVRPNNVTYNVMIHGYCTLGQWKEARKMFREMTRQGLIPDIVTWTSFMASLCKHGRTKEAAEFFDSMTAKGHKPDLVMYHVLLHGYATKGCFADMINLFNSMATKGIVPDRQVFNILIDAHAKHGMMDEAMHIFTGMQGQGVCPDVWTYSTLISALCRMGRLADAMDNFSQMIGKGVQPNTVVYHSLIQGFSTHGDLRKAKELVYEMTNKGIPCPNIAFFSSVMDGICKEGRVMDAHDIFHLVTDIGLKPNIITFNTLIDGHCLVGEMEKAFGVLDSMVSAGIEADVFTYNTLAYGYCRCGRIDDGLILFREMLQNKPKPTTITYNIILDGLFRAGRTFAAKKMFVEMIETGITVSISTYSIILGGLCRNNCSDEAITLFQKLGAMNVKFDIKILNTMINAMFKVRRREEANGLFAAISASGMVPNTSTYSVMIGNLLKEGSVEEAENMFSLMEKSGCAPDSRLINNIIRILLENGDIVKAGNYMSKVDGKSISLEASTTSLLMCLFSSKGKYREQISLLPVNYQFFNGVG

SEQ ID NO: 175 - protein, 824 aa, Triticum aestivum; identical to SEQ ID NO: 171

SEQ ID NO: 176 - protein, 836 aa, Triticum aestivum
MSRLRHSTSTAPMSRLRHSTSTAPMPHLRLLRCRSSSISTLPPSRSWSPVTAFAAATERVSAGTLSPEDAHRLFDELLRQATPVPARSLNGFLTALSRAPGTGACGDGPALALALFNRTRREEAGSRVVPSTIFTYGILMNCCRRTRRPELGLAFFGRVLRMGLRTNVVVATTVLQCLCGAKRTDEAVDILLHRMSELGCVPDAFSYSIVLKSLCDDGRSQRALDLLHMWEKERGLCSPNVVMYNTVIHDFFKEGEVSKACSLFHEMEQKGVVPNVVTYSLTIDALCKARAMDKAQLFLRQMIDKGVRPNNVTYNVMIHGYCTLGQWKEARKMFREMTRQGLIPDIVTWTSFMASLCKHGRTKEAAEFFDSMTAKGHKPDLVMYHVLLHGYATKGCFADMINLFNSMATKGIVPDRQVFNILIDAHAKHGMMDEAMHIFTGMQGQGVCPDVWTYSTLISALCRMGRLADAMDNFSQMIGKGVQPNTVVYHSLIQGFSTHGDLRKAKELVYEMTNKGIPCPNIAFFSSVMDGICKEGRVMDAHDIFHLVTDIGLKPNIITFNTLIDGHCLVGEMEKAFGVLDSMVSAGIEADVFTYNTLAYGYCRCGRIDDGLILFREMLQNKPKPTTITYNIILDGLFRAGRTFAAKKMFVEMIETGITVSISTYSIILGGLCRNNCSDEAITLFQKLGAMNVKFDIKILNTMINAMFKVRRREEANGLFAAISASGMVPNASTYSVMIGNLLKEGSVEEAENMFSLMEKSGCAPDSRLINNIIRILLENGDIVKAGNYMSKVDGKSISLEASTTSLLMCLFSSKGKYREQISLLPVNYQFFNGVS

SEQ ID NO: 177 - protein, 788 aa, Triticum aestivum
MPGFSSTASMSPLRLRLHARHSSSASQPSRSQGWDPHAAFAAATQRARSGSLTPADAHHLFDELLRQANPVQERPLNNLLAAIARAPASSACRDGPALAVALFSRISQGARRRVAHPTACTYGILMDCCCRARRPDLSLALFGRLLRTGLKADQVVFSTLLKGLCHAKRSDEALHVLLHRMPELGCTPDVVVFNTVIHGFFREGQVGKACDMFLGMAQQGVAPNVVTYNSVIDALCKARAMDKAEYFLRQMVDNGVVPDNVTYNSLIHGYSSSGHQKEVLRVLKEMTSQGIIPDVVTCNSLMAYLCKNGRSKEAAEFFDSMVMKGLKPNIVSYSTLLHGYATEGCLVDMINLFNSMTRDGIQPDCHVLNILINAYAKSGMMDEAILMFKEMQKRGVSPDVVTYSTVIHGFCKMGRLDDAMVKFKQMTDMGVRPNPIVYHSLIKGFCTHGDLVKAKELVTEMRNKAMRPPDIKFFHSIMQNLCTEGRVIEARDILDLMVHIGMRPDVLIFNVLIGGYCLVCKMEDASKIFDDMVSYGLEPCNITYGILINGYCKNRRIDEGLILFKEMLCKGLKPTTFNYNVILDGLFLAGRTVAAKEKFNEMVESGVSVCIDTCSIVLGGLCKNSCSSEAITLFRKLSTMNVKLDIKIVNIIIGAFYRVKRNQEAKDLFAAITANGLVPNAVTYSIMMTNLIKEGSVEEADNLFLSMEKSGSTANSWMLNNIIRRLLERREIVKAGNYMSKVDVKSYSLEAKTVSLLISLFSREGKYRDHIKLLPTKYQFLKEPATVE

SEQ ID NO: 178 - protein, 715 aa, Triticum aestivum
MPGFSSTASMSPLRLRLHARHSSSASQPSRSQGWDPHAAFAAATQRARSGSLTPADAHHLFDELLRQANPVQERPLNNLLAAIARAPASSACRDGPALAVALFSRISQGARRRVAHPTACTYGILMDCCCRARRPDLSLALFGRLLRTGLKADQVVFSTLLKGLCHAKRSDEALHVLLHRMPELGCTPDVVVFNTVIHGFFREGQVGKACDMFLGMAQQGVAPNVVTYNSVIDALCKARAMDKAEYFLRQMVDNGVVPDNVTYNSLIHGYSSSGHQKEVLRVLKEMTSQGIIPDVVTCNSLMAYLCKNGRSKEAAEFFDSMVMKGLKPNIVSYSTLLHGYATEGCLVDMINLFNSMTRDGIQPDCHVLNILINAYAKSGMMDEAILMFKEMQKRGVSPDVVTYSTVIHGFCKMGRLDDAMVKFKQMTDMGVRPNPIVYHSLIKGFCTHGDLVKAKELVTEMRNKAMRPPDIKFFHSIMQNLCTEGRVIEARDILDLMVHIGMRPDVLIFNVLIGGYCLVCKMEDASKIFDDMVSYGLEPCNITYGILINGYCKNRRIDEGLILFKEMLCKGLKPTTFNYNVILDGLFLAGRTVAAKEKFNEMVESGVSVCIDTCSIVLGGLCKNSCSSEAITLFRKLSTMNVKLDIKIVNIIIGAFYRVKRNQEAKDLFAAITANGLVPNAVTYSIMPGLKLSSILKPSIVNRLSFCLSQFVFPR

SEQ ID NO: 179 - protein, 813 aa, Triticum aestivum
MSRVRLHLHRRLLSSTSPPSRSWSPRDAFAAAAERVRAGTLSRDDAHHLFDKLFRQATPVPNRSLNGFLASLARATSTTACIKDGPALALALFNRVCREEAGPQVAAPTVCTYNILMDCCCRARRPDLGLALFGCILRTGLKIEQITANTLLKCLCYAKRTGEAVNVLLHRMSELGCVPDVFAYTTVLKSLCEGSKSLQALDLLRTMAKDRGGCFPDVVAYNTVIHGFFKEGETGKACNLFHEMIHQGVEPDVVTYNLVIDALCKARAMDKAEVVLQQMVDKGVQPDTVTYTYMIHGYSISGRWKETAKLFREMTSRGLIPNIVTCNSFLTSLCKHGRSKEAAEFFDSMTAKGHKPNIVSYRILLHGYATKGCFPDMIDVFNSMESNGIAADCHVFNILIDAYAKRGMMDEAMLIPSKMQERRVNPDIVTYSSIIAGLSRLGRLTEAMEKFNQMIALGVQPDKAVYHTLIQGFCIDGDLAKAKQLVSEMMNRGIPRPNIVFFNSVINSMCKEGRVMDAHDIFELVIDMGERPDNILFNSLIDGYCLVGKMDKALKVLDVMESVGVEPDVITYNTLVNGYCRNGRIVDGLTLFREMPRKRIKPDTISYRIIMDGLFRSGRTVSARQMFHEMIESGTTVSISTYNVILGGLCRNNCADEAIALFQKLGSMNVKFSIAIVNTMINAMYKVQRKEEAKDLFAAISASGLVHNESTYAVMIRNLLKDGAVEDANDMFSSMDKSGIVPSSHLINDIIRMLLERGEIANAGNYLSKVDGKSISLEASTTSLMLSLFSREGKYREDMKLLPAKYQFFDGLC

SEQ ID NO: 180 - protein, 814 aa, Triticum aestivum
MYLIHLHLHRRLFSSTARPSRPSRAWSPHAAFAAATERVRAGNFSWEDAHNLFDESLRRATPVPERSLDGFCAALARGHASEACRDGPALALALFNHVCRDESGARVAPPTIFTYGILMNCCCRAHRPDLGLAFFGRLLRTGLKADLIVANTLLKCLCRAKRTDEAVNVLLHRMSELGCVPDAFSYSIVLKSLCDNGMSQQALDLLHMMAKEGGGCSPDVVAYSTVIHGFFKEGETGKACNLFHEMLQQGVEPNVWTYSSIIDALCKARAMDKAELVLQQMVNKGVQPDNVTYNCMIHGYSTSGRWKEAVKLFREMKSRGLIPDNFTCNSLMTYLCKHGRSKEGAEFFDAMTAKGHRDVISYCVLLHGYANEGCFADMIDLFNSMERNGIAANCYVFNILVNGYAKRGMTDEAMLIFTEMWEKGVSPNVVTYSTVIAALSRMGRLTDSMDKFNQMIAMGIQPNTAVYHSLIQGCLMHGGLVKAKELMFEMMNKGIPCPNIVFFSSVINSLCKEGRVMDAHDVFDLAIGIGERPNVIIFNSLIDGYCLVGKMDKAFKILHVMESVGVESDVVTYSALLDGYFKNRRIDGALTLFREMPRKRIKPDTVTYNIMLDGLFRAGRTVAAMEMFHEMTESGATVRISTYNIILGGLCRNSCVDEAIALFQKLQAMNVKFIIEIFNTMIDAMYKVQRKEEAKDLFAAIPASGLVPNESTYAVMIRNLLKDGAVEDADNMFSSMDNSGIVPSSRLINDIIRMLLEKGEIAKAGNYLSKVDGKSISLEASTTSLMLSLFSRKGKHLEDIKLLPANYQFFDGFG

SEQ ID NO: 181 - protein, 814 aa, Triticum aestivum
MSLIHLHLHRRLFSSTARPSRPSRAWSPHAAFAAATERVRAGNFSWEDAHNLFDELLRRATPVPKRSLDGFLAALARAHASEACRDGPALALALFNLVCRDESGARVAPPTIFTYGILMNCCCRAHCPDLGLAFFGRLLRTGLKADLIVANTLLKCLCHAKRTDEAVNVLLHRMSKLGCVPDTFSYNIVLKSLCDNGMSQQALDLLHMMAKEGGGCPPDVVAYSTVIHGFFKEGETGKACNLFHEMMHQGVEPNVWTYSSIIDALCKARAMDKTELVLQQMVNKGVQPDNVTYNCMIHGYSTSGRWKEAVKLFREMKSRGLIPDISTCNSLMTYLCKHGRSKEGAEFFDAMTAKGHRDVISYCILLHGYANEGCFADMIDLFNSMERNGIAANCYVFNILINGYAKCGMTDEAMLIFTEMWEKGVSPNVVTYSTVIAALSRMGRLTDSMDKFNQMIAMGIQPNTAVYHSLIQGCLMHGGLVKAKELMFDMMNKGIPRPNIVFFSSVINSLCKEGRVMDAHAVFDLAIGIGERPDVITFNSLIDGYCLVGKMDTAFKILDVMELVGVEPDVVTYSALLDGYFKNRRIDDALTFFREMPCKRIKPNTVTYGIMLGGLFRAGRTVAAMKMFHEMIESGATVRISTYNIILGGLCQTNCVDEAIALFQKLRAMNVKFNIETLNTMINAMYKVQRKEEAKDLFAAIPASGLVPNESTYAVMIRNLLKDGAVEDADNMFSSMDNSGIVPSSRLINDIIRMLLEKGEIAKAGNYLSKVDGKSISLEASTTSLMLSLFSRKGKHLEDIKLLPAKYQFFDGFG

SEQ ID NO: 182 - protein, 814 aa, Triticum aestivum
MSLIHLHLHRRLFSSTARPSRPSRAWSPHAAFAAATERVRAGNFSWEDAHNLFDELLRRATPVPKRSLDGFLAALARAHASEACRDGPALALALFNLVCRDESGARVAPPTIFSYGILMNCCCRAHCPDLGLAFFGRLLRTGLKADLIVANTLLKCLCHAKRTDEAVNVLLHRMSKLGCVPDTFSYNIVLKSLCDNGMSQQALDLLHMMAKEGGGCPPDVVAYSTVIHGFFKEGETGKACNLFHEMMHQGVEPNVWTYSSIIDALCKARAMDKTELVLQQMVNKGVQPDNVTYNCMIHGYSTSGRWKEAVKLFREMKSRGLIPDISTCNSLMTYLCKHGRSKEGAEFFDAMTAKGHRDVISYCILLHGYANEGCFADMIDLFNSMERNGIAANCYVFNILINGYAKCGMTDEAMLIFTEMWEKGVSPNVVTYSTVIAALSRMGKLTDSMDKFNQMIAMGIQPNTAVYHSLIQGCLMHGGLVKAKELMFDMMNKGIPRPNIVFFSSVINSLCKEGRVMDAHAVFDLAIGIGERPDVITFNSLIDGYCLVGKMDTAFKILDVMESVGVEPDVVTYSALLDGYFKNRRIDDALTFFREMPCKRIKPNTVTYGIMLGGLFRAGRTVAAMKMFHEMIESGATVRISTYNIILGGLCQTNCVDEAIALFQKLRAMNVKFNIETLNTMINAMYKVQRKEEAKDLFAAIPASGLVPNESTYAVMIRNLLKDGAVEDADNMFSSMDNSGIVPSSRLINDIIRMLLEKGEIAKAGNYLSKVDGKSISLEASTTSLMLSLFSRKGKHLEDIKLLPAKYQFFDGFG

SEQ ID NO: 183 - protein, 814 aa, Triticum aestivum; identical to SEQ ID NO: 181

SEQ ID NO: 184 - protein, 814 aa, Triticum aestivum; identical to SEQ ID NO: 181

SEQ ID NO: 185 - protein, 814 aa, Triticum aestivum; identical to SEQ ID NO: 181

SEQ ID NO: 186 - protein, 814 aa, Triticum aestivum; identical to SEQ ID NO: 182

SEQ ID NO: 187 - protein, 772 aa, Triticum aestivum
MPTTRLSSVSASSFKASSRKPRAPLAALAAATERVRAGTLSQEDAHHLFDKLLGQATAVPERGLNNFLAALARASPSATCSDGPGLAVTLFNRMSLGAGARVASPTLCTYSILMDCCCRAGRPDLVVTFFGRLLRLGLRLNVVSFNNLLKGLCQAKRSNEALDLLLHRMPELDRAPDVFSFNIVINGCFREGEVDKACNLFHEMPQLGVQPDVVTYNSIIIALSRAGAMGKAEVVLRQMVDKGIGPDVMTYSSLIHGYSTSGQWKAAVRVFKEMVSVGVRPNAVTLNSFMDSLCKHRRTKEARDIFDSMAAKGHKPNIVSYSTMLNGYAKQGCFDDMTGLFNSMVQNGIVPNNHVFNILIRAYSTRGLMDEAMHMFEVMKQQGVNPDVVDYLVVIDSLCKMGRMDAAMDKFNQMVNQGVSPDIGIYQCLVLGSCSNGDFVKAKELISEAVNRGLCYNSVFFYPVINNLSKEGNVKDAQDMFDFIVGIGHQPDVIMYNSLMDGYCLVGKVEEALTVLDAMKSADLQPDAITYVILLNGYCKIGRIDDGLSLFREMSLSGVKPTTIMYNIALDGLFRSRRTVSAKEKFHTIIESGIPVDVGTYTIVLSGLCKNNCTDEAIELFNKLRAMNMKINVIILNTMISAMFKTRRIEEAKDLFATIPAIGLVPSVVTYTVMMTNFIKEGLLAEADDMFLAMEKAGCAPDCRLLNHVVRVLLEKGAVVKAATYLAKLDAKELSLEASTVSLIVSLFSRRGKLREHVKLLPVKYQPPEMLG

SEQ ID NO: 188 - protein, 439 aa, Triticum aestivum
MINLFNSMEGNGIVADCNVFNILIDAYAKCGMMHEAMLIFTKMREQGVSPNVCTYATVIAALCRMGRLSDAMGKLNEMIATGLQPDVAIYTSLIQGFCTHGDLGKVKELVSEMMNKGMPRPNIVFFSSVINSLCKEGRVTDVHSIFDLAINIGERPDVITFTSLIDGYCLVGKMDKAFKVLDDMVSAGIEPDVYTYTTLLDGYSRNGRIDDGLTLFSEMMHKKIKPTTATYGTLLNGLFRAWRTASAKKMIHEMIESGTTVSLSIYAIILEGLRRNNCTDEAITLFQKVRAMNIKLDVAILNTMINAMFKVQRREEANDLFASISASGLVPNASTYRTMITNLLKEGLVEEAENMLSSMEKSCCAPDSRLINDTIRILLEQGEVVKAGNYMSRVDGKSISLEASTTSLLIRLFSREGKYREKIKLLPVKYQFFGGATVE

SEQ ID NO: 189 - protein, 439 aa, Triticum aestivum; identical to SEQ ID NO: 188

SEQ ID NO: 190 - protein, 826 aa, Triticum aestivum
MRNKKKSHEEAILPASDLLQQRLLTIPPARTRRPCPSHASPLPHHAHAPPPLLRRRRLSSSSTSSPSRRWDPRAAFAAATERVRAGTLSPEDAHHLFDELLLQANPVPYRSLNGFLAALARAPSSAALRDGPSLALALFNRVCREEAGPRVAPPTVCTYSILMDSCCRACRPNLGLAFFGRFLRTGLKADQIVASNLLKCLCHAKRTDEAVNMLLHRMSEFGCVPNVISYSIVLKSLCDDSRSQQALDLLQMVRKEGGACSFNVVAYSTVIHGFFKEGEVSKACDLFHEMMQQGIVPNVVTYSSIIDALCKVRAMDKAKLVLQQMVDNGVRPNMYTWNSFMYSLCKNGRSKEAAEFFDSMTSKGLKPNIIVYSTLLHGYATEGCLADMINLFNSMEGNGIVADCNVFNILIDAYAKCGMMHEAMLIFTKMREQGVSPNVCTYATVIAALCRMGRLSDAMGKLNKMIATGLQLDVAIYTSLIQGFCTHGDLGKVKELVSEMMNKGMPRPNIVFFSSVINSLCKQGRVTDAHSIFDLAINIGERPHVITFTSLIDGYCLVCKMDKAFKVLDAMVSAGIEPDVYTYTTLLDGYSRNGRIDDGLTLFSEMMHNKTKPTTATHGTLLNGLFRAGRTASAKKMIHEMIESGTTVSLSIYAIILEGLCRNNCADEAITLFQKVRAMNIKLDVAILNTMINAMFKVQRREEANDLFASISASGLVPNASTYRTMITNLLKEGLVEEAENMLSSMEKSCCAPDSRLINDIIRILLEQGEVVKAGNYMSRVDGKSISLEASTTSLLIRLFSREGKYREKIKLLPVKYQFFGGATVE

SEQ ID NO: 191 - protein, 439 aa, Triticum aestivum; identical to SEQ ID NO: 188

SEQ ID NO: 192 - protein, 439 aa, Triticum aestivum
MINLFNSMEGNGIVADCNVFNILIDAYAKCGMMHEAMLIFTKMREQGVSLNVCTYATVIAALCRMGRLSDAMGKLNEMIATGLQPDVAIYTSLIQGFCTHGDLGKVKELVSEMMNKGMPRPNIVFFSSVINSLCKEGRVTDAHSIFDLAINIGERPDVITFTSLIDGYCLVGKMDKAFKVLDAMVSAGIEPDVYTYTTLLDGYSRNGRIDDGLTLFSEMMHKKIKPTTATYGTLLNGLFRAGRTASAKKMIHEMIESGTTVSLSIYAIILEGLRRNNCTDEAITLFQKVRAMNIKLDVAILNTMINAMFKVQRREEANDLFASISASGLVPNASTYRTMITNLLKEGLVEEAENMLSSMEKSCCAPDSRLINDIIRILLEQGEVVKAGNYMSRVDGKSISLEASTTSLLIRLFSREGKYREKIKLLPVKYQFFGGATVE

SEQ ID NO: 193 - protein, 826 aa, Triticum aestivum; identical to SEQ ID NO: 190

SEQ ID NO: 194 - protein, 664 aa, Triticum aestivum
MDSCCRACRPNLGLAFFGRFLRTGLKADQIVASNLLKCLCHAKRTDEAVNMLLHRMSEFGCVPNVISYSIVLKSLCDDSRSQQALDLLQMVRKEGGACSFNVVAYSTVIHGFFKEGEVSKACDLFHEMMQQGIVPNVVTYSSIIDALCKVRAMDKAKLVLQQMVDNGVRPNMYTWNSFMYSLCKNGRSKEAAEFFDSMTSKGLKPNIIVYSTLLHGYATEGCLADMINLFNSMEGNGIVADCNVFNILIDAYAKCGMMHEAMLIFTKMREQGVSPNVCTYATVIAALCRMGRLSDAMGKLNKMIATGLQPDVAIYTSLIQGFCTHGDLGKVKELVSEMMNKGMPRPNIVFFSSVINSLCKEGRVTDAHSIFDLAINIGERPDVITFTSLIDGYCLVGKMDKAFKVLDAMVSAGIEPDVYTYTTLLDGYSRNGRIDDGLTLFSEMMHNKIKPTTATHGTLLNGLFRAGRTASAKKMIHEMIESGTTVSLSIYAIILEGLCRNNCADEAITLFQKVRAMNIKLDVAILNTMINAMFKVQRREEANDLFASISASGLVPNASTYRTMITNLLKEGLVEEAENMLSSMEKSCCAPDSRLINDIIRILLEQGEVVKAGNYMSRVDGKSISLEASTTSLLIRLFSREGKYREKIKLLPVKYPFFGGATVE

SEQ ID NO: 195 - protein, 439 aa, Triticum aestivum; identical to SEQ ID NO: 188

SEQ ID NO: 196 - protein, 439 aa, Triticum aestivum; identical to SEQ ID NO: 188

SEQ ID NO: 197 - protein, 664 aa, Triticum aestivum; identical to SEQ ID NO: 194

SEQ ID NO: 198 - protein, 439 aa, Triticum aestivum; identical to SEQ ID NO: 188

SEQ ID NO: 199 - protein, 664 aa, Triticum aestivum; identical to SEQ ID NO: 194

SEQ ID NO: 200 - protein, 664 aa, Triticum aestivum; identical to SEQ ID NO: 194

SEQ ID NO: 201 - protein, 820 aa, Triticum aestivum
MSRLRHSTSTAPMFHLRLLRCRFSSISTLPPSRSWSPHAAFAAATERVIAGTLSPEDAHRLFDELLRQATPVPARSLNGFLTALSRAPDTGACRDGPALFNRTRREEAGSRVVSSTIFTYGILMNCCGRTRRPELGLAFFGRVLRMGLKTNVVVATMVLQCLSSAKRTDEAVDILLHRISELGCVPDAFSYSIVLKSLCDDSRSQRALDLLHMWEKERGVCSPNVVTYNTGIHGFFKEGEVSKACNLFHEMVQKGVEPNVVTYSLTIDALCKARAMDKAELFLRQMIDKGVQPNNVTYNVMIHGYSTLGQWKEAGKMFREMTRQGLIPDLVTWTSFMASLCKHGRTKEAAEFFDSMTAKGHKPDLVTYHVLLHGHATEGCFADMINLFNAMATKGILPDRQVFNILIDAHAKHRMMDEAMHIFTGMQGQGVCPDVWTYSTLISALCRMGRLADAMDNFSQMIGKGVQLNTVVYHSLIQGFSTHGDLRKAKELVYEMTNKGIPCPNIAFFSSIMDSLCKEGRVMDAHDIFHLVTDIGLKPNIITFNTLIDGYCLVGEMEKAFGVLDSMVSAGIEADVFTYNTLAYGYCRCGRTDDGLILFREMVQNKPKPTTITYNIILDGLFRAGRTFAAKKMFLEMTETGITVSISTYSIILGGLCRNNCSDEAITLFQKLGAMDVKFDIKILNTMINAMFKVRRREEANGLFAGISASRMVPNASTYSVMIGNLLKEGSVEEAENMFSLMEKSGCAPDSRLINNIIRILLENGDIVKAGNYMSKVDGKSISLEASTTSLLMCLFSSKGKYREQISLLPVNYQFFNGVS

SEQ ID NO: 202 - protein, 820 aa, Triticum aestivum; identical to SEQ ID NO: 201

SEQ ID NO: 203 - protein, 824 aa, Triticum aestivum
MSRLRHSTSTVPMFHLRLLRCRFSSISTLPPSRSWSPHAAFAAATERVIAGTLSPEDAHRLFDELLRQATPVPARSLNGFLTALSRAPDTGACRDGPALALALFNRTRREEAGSRVVSSTIFTYGILMNCCRRTRRPELGLAFFGRVLRMGLKTNVVVATMVLQCLCSAKRTDEAVDILLHRMSELGCVPDAFSYSIVLKSLCDDSRSQRALDLLHMWEKERGVCSPNVVTYNTVIHGFFKEGEVSKACNLFHEIVQKGVEPNVVTYSLTIDALCKARAMDKAELFLRQMIDKGVQPNKVTYNVMIHGYSTLGQWKEAGKMFREMTRQGLIPDLVTWTSFMASLCKHGRTKEAADFFDSMTAKGHKPDLVTYHVLLHGHATEGCFADMINLFNAMATKGILPDRQVFNILIDAHAKHGMMDEAMHIFTGMQGQGVCPDVWTYSTLISALCRMGRLADAMDNFSQMIGKGVQPNTVVYHSLIQGFSTHGDLRKAKELVYEMTNKGIPCPNIAFFSSIMDSLCKEGRVMDAHDIFHLVTDIGLKPNIITFNTLIDGYCLVGEMEKAFGVLDSMVSAGIEADVFTYNTLAYGYCRCGRIDDGLILFREMVQNKPKPTTITYNIILDGLFRAGRTFAAKKMFLEMTETGITVSISTYSIILGGLCRNNCSDEAITLFQKLGAMDVKFDIKILNTMINAMFKVRRREEANGLFAGISASRMVPNASTYSVMIGNLLKEGSVEEAENMFSLMEKSGCAPDSRLINNIIRILLENGDIVKAGNYMSKVDGKSISLEASTTSLLMCLFSSKGKYREQISLLPVNYQFFNGVS

SEQ ID NO: 204 - protein, 820 aa, Triticum aestivum; identical to SEQ ID NO: 201

SEQ ID NO: 205 - protein, 820 aa, Triticum aestivum; identical to SEQ ID NO: 201

SEQ ID NO: 206 - protein, 820 aa, Triticum aestivum
MSRLRHSTSTAPMFHLRLLRCRFSSISTLPPSRSWSPHAAFAAATERVIAGTLSPEDAHRLFDELLRQATPVPARSLNGFLTALSRAPDTGACRDGPALFNRTRREEAGSRVVSSTIFTYGILMNCCGRTRRPELGLAFFGRVLRMGLKTNVVVATMVLQCLSSAKRTDEAVDILLHRMSELGCVPDAFSYSIVLKSLCDDSRSQRALDLLHMWEKERGVCSPNVVTYNTVIHGFFKEGEVSKACNLFHEMVQKGVEPNVVTYSLTIDALCKARTMDKAELFLRQMIDKGVQPNNVTYNVMIHGYSTLGQWKEAGKMFTEMTRQGLIPDLVTWTSFMASLCKHGRTKEAAEFFDSMTAKGHKPDLVTYHVLLHGHATEGCFADMINLFNAMATKGILPDRQVFNILIDAHAKHGMMDEAMHIFTGMQGQGVCPDVWTYSTLISALCRMGRLADAMDNFSQMIGKGVQPNTVVYHSLIQGFSTHGDLRKAKELVYEMTNKGIPCPNIAFFSSIMDSLCKEGRVMDAHDIFHLVTDIGLKPNIITFNTLIDGYCLVGEMEKAFGVLDSMVSAGIEADVFTYNTLAYGYCRCGRIDDGLILFREMVQNKPKPTTITYNIILDGLFRAGRTFAAKKMFLEMTETGITVSISTYSIILGGLCRNNCSDEAITLFQKLGAMDVKFDIKILNTMINAMFKVRRREEANGLFAGISASRMVPNASTYSVMIGNLLKEGSVEEAENMFSLMEKSGCAPDSRLINNIIRILLENGDIVKAGNYMSKVDGKSISLEASTTSLLMCLFSSKGKYREQISLLPVNYQFFNGVS

SEQ ID NO: 207 - protein, 825 aa, Triticum aestivum
MPRSRLRRYASTMPMSSLRPLHRSSSSTTSPARAWSPHAAFAAATERVRAGTVRPEDAHTLFDELLRQATPVPQRSLNGFLAALARAPASGACIRDGPALAVALFNRVCRDEAGPQVAALTGCTYSILMDCCCRARRPDLGLALFGRFLREGLKTDQIVANTFLKCLCYAKRTDEAVDVLLHRMSELGCVPDAFSYNTVLKSLCDNGMSQRALDLLQRMAKEGGVCSLNLVAYNTVIHGFFKEGETGKACSLFHEMMQQGVVPNVWTYTSIIDALCKARAMDKAELVLRQMVAKGAQPDIVTYTCMINGYATSGRLKEAAKMFREMKSRGLTPNIVTCGSLMTYLCKHGRSKEAREIFDSMTAKGHRANVVSYCILLHGYANEGCFADMIDLFNSMKSNGIAADCRVFNILINGYAKRGKMDEAMLIFTEMWEKGVSPDVVTYSTVIAALSRMGRLTDAMDKFNQMISMGVQPNTAVYHSLIQGSCMHGDLIKAKELVSEMMNKGIPRPSIAFFGSIINRLCKDGRVMDAHDIFDLVIDIGERPSVITFNSLIDGYCLVGKMDKAFKILDAMEVVGVESDVITYSTLLDGYFKNGRINDGLTLFREMPHKGIKPDTVTYGIMLDGLFRAGRTVAVRTVFHEMIESGITVDIPTYNIVLGGLCRNNCTDEAIALFQKLGAMSVKSNIAILNTMIDGMYKVRRREEANDLFATISASGLVPNESTYAVMIINLLKDGAVEEADNMFSSMEKTGIVPSSRLLNHIIRMLLEIGEIAKAGNYLSKVDGKSISLEASTTSLMLSFFSKKGKYREDMKLLPAKFQIFDGFG

SEQ ID NO: 208 - protein, 825 aa, Triticum aestivum
MPRSRLRRYASTMPMSSLRPLHRSSSSTTSPARAWSPHAAFAAATERVRAGTVRPEDAHTLFDELLRQATPVPQRSLNGFLAALARAPASGACIRDGPALAVALFNRVCRDEAGPQVAALTGCTYSILMDCCCRARRPDLGLALFGRFLREDLKTDQIVANTFLKCLCYAKRTDEAVDVLLHRMSELGCVPDAFSYNTVLKSLCDNGMSQRALDLLQRMAKEGGVCSLNLVAYNTVIHGFFKEGETGKACSLFHEMMQQGVVPNVWTYTSIIDALCKARAMDKAELVLRQMVAKGAQPDIVTYTCMINGYATSGRLKEAAKMFREMKSRGLTPNIVTCGSLMTYLCKHGRSKEAREIFDSMTAKGHRANVVSYCILLHGYANEGCFADMIDLFNSMKSNGIAADCRVFNILINGYAKRGKMDEAMLIFTEMWEKGVSPDVVTYSTVIAALSRMGRLTDAMDKFNQMISMGVQPNTAVYHSLIQGSCMHGDLIKAKELVSEMMNKGIPRPSIAFFGSIINRLCKDGRVMDAHDIFDLVIDIGERPSVITFNSLIDGYCLVGKMDKAFKILDAMEVVGVESDVITYSTLLDGYFKNGRINDGLTLFREMPHKGIKPDTVTYGIMLDGLFRAGRTVAVRTVFHEMIESGITVDIPTYNIVLGGLCRNNCTDEAIALFQKLGAMSVKSNIAILNTMIDGMYKVRRREEANDLFATISASGLVPNESTYAVMIINLLKDGAVEEADNMFSSMEKTGIVPSSRLLNHIIRMLLEIGEIAKAGNYLSKVDGKSISLEASTTSLMLSFFSKKGKYREDMKLLPAKFQIFDGFG

SEQ ID NO: 209 - protein, 825 aa, Triticum aestivum; identical to SEQ ID NO: 208

SEQ ID NO: 210 - protein, 825 aa, Triticum aestivum; identical to SEQ ID NO: 208

SEQ ID NO: 211 - protein, 825 aa, Triticum aestivum; identical to SEQ ID NO: 207

SEQ ID NO: 212 - protein, 825 aa, Triticum aestivum; identical to SEQ ID NO: 208

SEQ ID NO: 213 - protein, 825 aa, Triticum aestivum
MPRSRLRRYASTMPMSSLRPLHRSSSSTTSPARAWSPHAAFAAATERVRAGTLRPEDAHTLFDELLRQATPVPDRSLNGFLAALAHAPASGNCIRDGPALAVALFNRVCREEAGPRVAVLTGCTYSILMDCCCRARRPDLGLALFGRFLREGLKTDQIVANTFLKCLCYAKRTDEAVDVLLHRMSELGCVPDAISYNTVLKSLCDNGMSQRGLELLQMIAKEGGVCSLNLVAYNTVIYGFFKEGETGKARNLFHEMMQQGVEPDVVTYNLIIDALCKARAMDKAEVVLQQMISKGAQPDTVTYNCMINGYATSGRLKESAKLFREMKSRGLTPNNVTCNSFLSSLCKHGRSKEAREIFDSMTAKGRRANVVSYSILLHGYANEGCFADMIDLFNSMKSNGIAADCRVFTILIDAYAKRGMMDDAMHIFTEMQQQGVSPNVVTYSTVISALSRMGRLTDSMEKFNQMVALGVQPDRAIYRSLIQGFCMHGGLVKAKELVSQMINKGIPRPSIEFFNSVINSMCKEGRVMDAHDIFDLVIDIGERPDDITFNSLIDGYCLVGKMDKAFKILDAMEVVGVEPDVITYNTLLDGYFKNGRINDGLALFREMPHKRIKPDIVTYGIMLDGLFRAGRTVSARTMFHEMIESGITVNIFTYNIVLGGLCRNNCTDEAIALFQKLGAMSVKFNIATLNTMIDGMYKVRRREEANDLFATISASGLVPNESTYAVMIINLLKDGAVEEANNMFSSMEKTGIVPSSRLLNRIIRMLLEIGEIAKAGNYLSKVDGKSISLEASTTSLMLSFFSKKGKYREDMKLLPAKFQFFDGFG

SEQ ID NO: 214 - protein, 814 aa, Triticum aestivum
MSRIRLRRRRRHRLPSSTSRPSPSWSPHAACAAATERVRAGTLSPQDAHHLFDELLRQATPVPERSLNGFLAALSRATPSKACRDGPALVLSLFNRVCREEAGGMRVAPPTIFTYGVLMNCCCRTRRPELGLAFFGRLLRTGLKADKTIANTVLKCLCCAKRTDDAVKVLRRRMSELGCVPDAFSYAIVLKGLCDDNRSQQALDLLRMMAKEGVCSPDVVTYNTVIHGFFKEGKIGKACNLFHEMTKQGFVPNVVTYNSVISALCKARAMDNAELFLREMVDNGVQPNKVTYTSMIHGYSTLGQWKEATKLFREMTSSGLIPDIVTWNSFIDSLCKHGRSKEAAENFHSMSAKGHKPDIISYATLLHGYANEGSFPDMMSFFKSMEGDGIVANCQVFNILIDAYAKRGMMDEAMLIFTEMPGQGVNPNVVTYSTVIASLCRMGRLADAMNKFSEMIGTGVQPNTVVYHSLVQGLCTHGDLVKAKELISEMMNKGIPRPNIAFFSSIVHSLCKEGRVMDAHHIFDLVKDIGERSDIIMFNTLIDGYCLIGEMGKAVSVLDVMISAGIEPDIFTYNTLVNGYFKSGRIDDGLNLFREMSHKKIKPSTVTYNIILDGLFRAGRTVAAKKMLHEMIGCGTTVSLSTYNIILRGLCRNNCTDEAIAMFQKLRTINVKFNITTLNTMINSMYTVQRREEAKDLFAAISDSGLVPNVSTYGIMIRNLLKEGSVKEADNMFLSMEKSGCAPCSRLLNDTIRTLLEKGEIVKAGNYMSKVDGKSISLEASTSSLLLSLFSGKGKYREQIQLLPVKYQFFGGVS

SEQ ID NO: 215 - protein, 814 aa, Triticum aestivum; identical to SEQ ID NO: 214

SEQ ID NO: 216 - protein, 814 aa, Triticum aestivum
MSRIRLRRRRRHRLPSSTSRPSPTLSPHAACAAATERVRAGTLSPQDAHHLFDELLRQATPVPERSLNGFLAALSRATPSKACRDGPALVLSLFNRVCREEAGGMRVAPPTIFTYGVLMNCCCRTRRPELGLAFFGRLLRTGLKADKTIANTVLKCLCCAKRTDDAVKVLRRRMSELGCVPDAFSYAIVLKGLCDDNRSQQALDLLRMMAKEGVCSPDVVTYNTVIHGFFKEGKIGKACNLFHEMTKQGFVPNVVTYNSVINALCKARAMDNAELFLQQMVDDGVQPNKVTYTSMIHGYSTLGQWKEATKLFREMTSSGLIPDIVTWNSFIDSLCKHGRSKEAAEIFHSMSAKGHKPDIISYATLLHGYANEGSFPDMMSLFKSMEGDGIVANCQVFNILIDAYAKRGMMDEAMLIFTEMPGQGVNPNVVTYSTVIASLCRMGRLADAMNKFSEMIGTGVQPNTVVYHSLVQGLCTHGDLVKAKELISEMMNKGIPRPNIAFFSSIVHSLCKEGRVMDAHHIFDLVKDIGERSDIIMFNTLIDGYCLIGEMGKALRVLDAMISAGIEPDIFTYNTLVNGYFKSGRINDGLSLFREMSHKEIKPTTVTYNIILDGLFRAGRTVAAKKMLHEMTGCGTTVSLSTYNIILRGLCRNNCTDEAIAMFQKLHTMNVKFNITTLNTMINSMYTVQRREEAKDLFAAISDSGLVPNASTYDIMIRNLLKEGSVEEADNMFLSMEKSGCAPCSRLLNDTIRTLLEKGEIVKAGNYMSKVDGKSISLEASTSSLLLSLFSGKGKYREQIQLLPVKYQFFGGVS

SEQ ID NO: 217 - protein, 814 aa, Triticum aestivum
MSRIRLRRRRRHRLPSSTSRPSPSWSPHAACAAATERVRAGTLSPQDAHHLFDELLRQATPVPERSLNGFLAALSRATPSKACRDGPALVLSLFNRVCREEAGGMRVAPPTIFTYGVLMNCCCRTRRPELGLAFFGRLLRTGLKADKTIANTVLKCLCCAKRTDDAVKVLRRRMSELGCVPDAFSYAIVLKGLCDDNRSQQALDLLRMMAKEGVCSPDVVTYNTVIHGFFKEGKIGKACNLFHEMTKQGFVPNVVTYNSVISALCKARAMDNAELFLREMVDNGVQPNKVTYTSMIHGYSTLGQWKEATKLFREMTSSGLIPDIVTWNSFIDSLCKHGRSKEAAENFHSMSAKGHKPDIISYATLLHGYANEGSFPDMISFFKSMEGDGIVANCQVFNILIDAYAKRGMMDEAMLIFTEMPGQGVNPNVVTYSTVIASLCRMGRLADAMNKFSEMIGTGVQPNTVVYHSLVQGLCTHGDLVKAKELISEMMNKGIPRPNIAFFSSIVHSLCKEGRVMDAHHIFDLVKDIGERSDIIMFNTLIDGYCLIGEMGKAVSVLDVMISAGIEPDIFTYNTLVNGYFKSGRIDDGLNLFREMSHKKIKPSTVTYNIILDGLFRAGRTVAAKKMLHEMIGCGTTVSLSTYNIILRGLCRNNCTDEAIAMFQKLRTINVKFNITTLNTMINSMYTVQRREEAKDLFAAISDSGLVPNVSTYGIMIRNLLKEGSVKEADNMFLSMEKSGCAPCSRLLNDTIRTLLEKGEIVKAGNYMSKVDGKSISLEASTSSLLLSLFSGKGKYREQIQLLPVKYQFFGGVS

SEQ ID NO: 218 - protein, 814 aa, Triticum aestivum; identical to SEQ ID NO: 214

SEQ ID NO: 219 - protein, 814 aa, Triticum aestivum; identical to SEQ ID NO: 214

SEQ ID NO: 220 - protein, 814 aa, Triticum aestivum; identical to SEQ ID NO: 214

SEQ ID NO: 221 - protein, 812 aa, Triticum aestivum
MSNLRLLRRSSSSTSTPTSWSSRSWSPHAAFAAATERVRAGTLNQDDAHHLFDELLRQANPVPGRSLNGFLAALARATSSAACIRDGPTLAIALFNRLCREQAGLRVAPLTIHTYGILMDCCCRASRPELGLALFGRFLRTGLKTNEIVASTFLKCLCYAKRTDEAVNVLLHRMSELGCVPNAISYSIVLKSLCDNSMSLRALDLLQMMAKEGGACSPNVVAYSTVIHGFFKESETGKACNLFHEMMQQGVEPSVWTYSSIIDALCKARAMDKAELVLQQMVNKGVQPNNVTYNCMIHGYSTSGQWKEAAKLLREMKSRGLIPDIVTCNSFLASLCKHGRSKEAAEFLDSMTAKGHKPDIVSYRILLHGYGTEGCFADMIDVFYSMESNGIAADCHVFNILINGYAKRGMTEEAMLIFTEMQGQGVSPDVVTYSIVIAALSRMGRLTDAIEKFNEMTALEVQPDTTVYHSLIQGCCIDGYLVKAKELMFEMMNGGIPRPNIVFFSSVINSLCKEGRVMDAHDVLDLVIGIGERPNVITFNSLIDGYCLVGNMDKAFKILDVMESVGVEPNVVTYSALLDGYSKNRRIDDALTLFREMPRKRIKPDTVTYGIMLDGLFRAGRTVAAMEMFHEMTESGTTVDIFIYNIILGGLCRNNCVDEAIALFQKLRAMNVKFNIEILNTMINAMYKVQRKEEAKELFATISANGLVPNESTYAVMIRNLLKGGAVEDADNMFSSMDNSGIVPSSRLINDIIRMLLKKGEIAKAGNYLSKVDGKSISLEASTTSLLLSRKGKHQVDIKLLPAKYQFFDGFG

SEQ ID NO: 222 - protein, 812 aa, Triticum aestivum; identical to SEQ ID NO: 221

SEQ ID NO: 223 - protein, 812 aa, Triticum aestivum; identical to SEQ ID NO: 221

SEQ ID NO: 224 - protein, 774 aa, Triticum aestivum
MPTARLSSVSASSFKASSRKPRAPLAALAAATERVRAGTLSQEDAHHLFDELLGQATAVPERGLNNFLAALARASPSATCSDGPGLAVTLFNRMSLGAGARVASPTLCTYSILMDCCCRAGRPDLVVAFFGRLLRLGLRLNVISFNNLLKGLCQAKRSNEALDLLLHRMPELDCAPDVFSFNIVINGCFREGEVDKACNLFHEMPQLGVQPDVVTYNSIIIALSRAGAMGKAEVVLRQMVDKGIGPDVMTYNSLIHGYSTLGQWKAAVRVFKEMVSVGVLPNAVTLNSFMDSLCKHRRTKEARDIFDSMAAKGHKPNIASYSTMLNGYAKQGCFDDMTGLFNSMVQNGIVPNNHVFNILIRAYSTRGLMDEAMHMFEVMKQQGVNPDVVDYLVVIDSLCKMGRMDAAMDKFNQMVNQGVSPDIVVYQCLVLGSCSNGDFVKAKELISEAVNRGLCSNSVFFYPVINNLSKEGNVKDAQDMFDFIVGIGHQPDVIMYNSLMDGYCLVGKVEEAMTVLDAMKSAGLQPDAITYAILLNGYCKIGRIDDGLSLFREISLSRVKPTTIMYNIILDGLFCCGRTVFAKEEFDTMIESGIPVGIDTCTIVLSGLCKNNCTDEAIELFKKLCAMNVKFDVIILTTMISAMFKTRRVEEAKDLFATISTIGLVPSVVTYSVMMTNFIKEGSLAEADDMFLAMEKAGCAPDSRLLNHVVRVLLEKGAVVKAATYLGKLDGKQLSLEASTVSLIVSLFSRKGKLREHVKLLPVKYQPPESSTDN

SEQ ID NO: 225 - protein, 774 aa, Triticum aestivum; identical to SEQ ID NO: 224

SEQ ID NO: 226 - protein, 774 aa, Triticum aestivum; identical to SEQ ID NO: 224

SEQ ID NO: 227 - protein, 823 aa, Triticum aestivum
MSRLRSASTAPMPRLRLLSCRSYSISTLPPSRSWSPHAAFAAATERVSAGTLTPEDAHHLFDELLRQSTPVPARSLNGFLTALARARDTDACRDGPALALALFNRTRREEAGSRVVSPTIFTYGILMNCCCHTLRPDLGLAFFGRVLRMGLKTNVVVATTVLKCLCGAKRTDEAVNILLHRMSELGCVPDDFSYSIVLKSLCDDGRSQRALDLLQMWEKERGVCSPNVVAYNIVIHGFFKEGEVSKACDLFHAMVQRGVVPNVMTYTLTIDALCKARAMDKAKLFLRQMIDKGVRPNNVTYNVMIHGYSTLGQWKEAGKVFREMSRQGLIPDIVTWTSFMASLCKHGRTKEAANFFDSMTAKGHKPDLVTYHVLLHGYGTEGCFADMINLVNSMATKGIVPDRQVFNILIDAHAKHGMMDEAMHIFTGMQGQGVCPDVWTYSTIISALCRMGRLADGMDNFSQMIGKGVEPNTVVYHSLIQGFSTHGDLRKAKELVYEMRNKGIPCPNIAFFTSIMDSLCKEGRVMDAHDIFNLVTDIGEKPNVITFNTLIDGHCLVGEMEKAFGVLDSMVSAGIEADVFTYNTLAYGYCRCGRIDDGLILFREMLRKKPKPTTITYNIILDGLFRAGRTVAAKKMFHEMIEGGITVSMSTYSIILGGLCRNNCAEEAITLFQKLGAMNVKLDIRILNTMINAMFKVRRREEANSLFAAISASGMAPNASTYGLMIGNLLKEGSVQEAENMFSLMEKSGCAPGSRLINNIIRILLEKGDIVKAGNYMSKVDGKTISLEASTTSLLMCLFSSKGRYREQINLLPGNYQFFNGVS

SEQ ID NO: 228 - protein, 772 aa, Triticum aestivum
MPTARLSSVFASSFKSSLRKPRAPVAALAAATERVRARTLSQQDAHHLFDELLSQAAAVPERGLNNFLAALARAPPSSACSDGPGLAIALFNRMSQGAGARVVSPTLCTYSILMDCCCRAGRPDLVVAFFGRLIRLGLRLDVIAFSNLLKGLCKAKRSNEALDLLLHRMPELDCAPDVFSYSIVINGCFKEGEVDKACNLFHEMIQLGVQPDVAIYTSIIDALSKCGAMDKAEVVLRQMVDQGIGPDVMTYSSLIHGYSTLGQWKAAVRVLKEMVSVGVRPDAVTLNSFMDSLCKHRRTKEARDIFDSMAAKGHKPNIVSYTIMLNGYVKEGCFDDMTGLINSMLQNGIVPDHHVFNILINAYSKRGLMDEAMHMFEVMKQQGVNPDVVDYLVVMDSLCKMGKMAAAMDKFNQMINQGVSPNKAVYQCLVLGSCSHGDFVKAKELISEAVNRGLCSNSVFFYPVINDLCKEGKVKEAQDMFDFIVGIGQRPDVIMYNSLMDGYCLVGKVEEALRVLDAMKSAGLQPDAITYAILLNGYCKIGRIADGLSLFREMSLSGVKPTTIMYSIILDGLFRSGRTVSAKEKFNTMVESGLPVDVRTYNIVLHGLCRNNCTGEAIELFKKLCATNLKINVITFNTMISAMFKTRRIGEAKDLFATISAIGLVPSVVTYSVMTTNFIKEGLLAEADDMFLAMEKAGCAPDSRLLNHVVSVLLENGAVVKAATYLAKLDAKQLSLEASTVSLIVSLFSRKGKLREHVKLLPVKYQPPEMLG

SEQ ID NO: 229 - protein, 772 aa, Triticum aestivum; identical to SEQ ID NO: 228

SEQ ID NO: 230 - protein, 772 aa, Triticum aestivum
MPTARLSSVFASSFKSSLRKPRAPVAALAAATERVRARTLSQQDAHHLFDELLSQAAAVPERGLNNFLAALARAPPSSACSDGPGLAIALFNRMSQGAGARVVSPTLCTYSILMDCCCRAGRPDLVVAFFGRLIRLGLRLDVIAFSNLLKGLCKAKRSNEALDLLLHRMPELDCAPDVFSYSIVINGCFKEGEVDKACNLFHEMIQLGVQPDVAIYTSIIDALSKCGAMDKAEVVLRQMVDQGIGPDVMTYSSLIHGYSTLGQWKAAVRVLKEMVSVGVRPDAVTLNSFMDSLCKHRRTKEARDIFDSMAAKGHKPNIVSYTIMLNGYVKEGCFDDMTGLINSMLQNGIVPDHHVFNILINAYSKRGLMDEAMHMFEVMKQQGVNPDVVDYLVVMDSLCKMGKMAAAMDKFNQMINQGVSPNKAVYQCLVLGSCSHGDFVKAKELISEAVNRGLCSNSVFFYPVINDLCKEGKVKEAQDMFDFIVGIGQRPDVIMYNSLMDGYCLVGKVEEALRVLDAMKSAGLQPDAITYAILLNGYCKIGRIADGLSLFREMSLSGVKPTTIMYSIILDGLFRSGRTVSAKEKFNTMVESGLPVDVRTYNIVLHGLCRNNCTGEAIELFKKLCATNVKINVITFNTMISAMFKTRRIGEAKDLFATISAIGLVPSVVTYSVMTTNFIKEGLLAEADDMFLAMEKAGCAPNSRLLNHVVRVLLENGAVVKAATYLAKLDAKQLSLEASTVSLIVSLFSRKGKLREHVKLLPVKYQPPEMLD

SEQ ID NO: 231 - protein, 772 aa, Triticum aestivum; identical to SEQ ID NO: 228

SEQ ID NO: 232 - protein, 772 aa, Triticum aestivum; identical to SEQ ID NO: 230

SEQ ID NO: 233 - protein, 772 aa, Triticum aestivum; identical to SEQ ID NO: 228

SEQ ID NO: 234 - protein, 772 aa, Triticum aestivum
MPTARLSSIFTSSFKAPSRERRAPLAALAAATERVRAGTLSRQDAHHLFDELLSQAATVPVRTLNNFLAALARAPPSAACGNGPALAVTLFNGMSRGAGARVVSPTCCTYSILMDCCCRAGRPDLVVAFFGRLLRLGLRLNVISLSNLLKGLCQAKRTNEAVDLLLHRTPELDCVPDVFSYSIVINGCLKEGEVDKACNLFHEMPQLGVQPDVVTYTSIIDALSKSGAMVKAEVVLRRMVGQGIGPNVMTYTSLIHGYSASGQWKAAVRVFKEMVSVGVLPNAVTLNSFMDSLCKHRRTKEARVIFDSMAAKGQKPDIVSYSIMLNGYVKEGCFDDMTGLFNSMLQNGVVPNHHIFNILINAYAKRGLMDEAMHMFEVMRQQGVNPDVFGYQIIMDSFCKMGRMDAALDKFNQMVNQGVSPNKAVYQCLVLGSCSHGDFVKAKELICEAVNRGLCSNSVFFYPVINDLCKEGKVKEAQDMFDFILGIGQRPDVIMYNSLMDGYCLVGKVEEALRVLDAMKSAGLQPTAVTYAILLNGYCKIGKIADGLSLFREMSLSGVKPTTIMYNIILDGLFRSGRTVSAKEKFNTMVESGLPVDVRTYNIVLHGLCRNNCTGEAIELFKKLCATNVKINVITFNTMISAMFKTRRIGEAKDLFATISAIGLVPSVVTYSVMMTNFIKEGLLAEADDMFLAMEKAGCAPNSRLLNHVVRALLEKGAVVKAATYLAKLDAKQLSVEASTISLIVSLFSGEGKLREHVELLPVKYQPPEMLD

SEQ ID NO: 235 - protein, 772 aa, Triticum aestivum; identical to SEQ ID NO: 234

SEQ ID NO: 236 - protein, 772 aa, Triticum aestivum; identical to SEQ ID NO: 234

SEQ ID NO: 237 - protein, 772 aa, Triticum aestivum; identical to SEQ ID NO: 234

SEQ ID NO: 238 - protein, 772 aa, Triticum aestivum; identical to SEQ ID NO: 234

SEQ ID NO: 239 - protein, 772 aa, Triticum aestivum; identical to SEQ ID NO: 234

SEQ ID NO: 240 - protein, 786 aa, Triticum aestivum
MPRFSSTTPMSPLRRRLRARHSSSTSHSSRSWEPHAAFAAAAERARSGNLTPEDAHHLFDELLRQGNPVQDRPLNKLLSALARAPASAACRNGPALAVALFSRISQGARRRVADPTACTYGILMDCCCRAHRLDLTLAFFGGLLKTGLKAGVIQVCTLLKGLCRAKRADEALDVLLHRMPELGCTPNVVAYTTVIHGFFKEGQVGKACNLFHGMAQQGVAPNLVTYNSVIDALCKAKAMDKAEYFLGQMVDDGVVPDNVTYNSLIHGYSSSGHWKEAVRVFKEMTSRRVTADVHTYNMFMTFLCKHGRSKEAAGIFDTMALKGLKPDNVSYAILLHGYATVGCLVDMINLFNSMERDCILPDCRIFNILINAYAKSGKLDKAMLIFNEMQKQGVSPNAVTYSTVIDAFCKKGQLDDAMIKFNQMIDTGVRQGTAVYGSLIQGFCTHGDLVKAKELLTEMMNKGISPPDIKFFHSIMQNLGTEGRVIEARDVLGLIAHIGMRPNVCTFNILIGGYCLVGKMEDASKIFDDMMSYGLEPSNITYGILINGYCKNERINDGLILFKEMLRKGLKPTTFNYNVILDGLFLTGRTVAAKEKFDEMVESGVSVCIDTYSIVLGGLCRNNCSGEAITLFQKLSTMDVKFNITIVNIMIDAFYRVQRNQEAKDLFAAVSANGLVANVFTYTIMMKNLIKEGSVEEADNLFLSMEKSGCTADSYMLNLIVRMLLEKGELVKAGNYMSKVDAMSYSLEAETVSLLISLFSGKGKYREHIGLLPAKYRFREEAATVV

SEQ ID NO: 241 - protein, 503 aa, Triticum aestivum
MTSRRVTADVHTYNMFMTFLCKHGRSKEAAGIFDTMAMKGLKPDNVSYAILLHGYATEGCLVDMINLFNSMERDCILPDCRIFNILIKAYAKSGKLDKAMLIFNEMQKQGASPDAVTYSTVIDAFCKKGQLDDAMIKFNQMIDTGVPQGTAVYGSLIQGFCTHGDLVKAKELVTEMMNKGIPPPDIKFFHSIMQNLCTEGRVIEARDVLGLIAHIGMKPNVCTFNILSGGYCLVGKMEDASKIFDDMMSYGLEPSNITYGILINGYCKNERINDGLILFKEMLCKGLKPTTFNYNVILDGLFLTGRTVAAKEKFDEMVESGVSVCIDTYSIVLGGLCRNNCSGEAIMLFQKLSTMDVKFNITIVNIMIDAFYRVQRNQEAKDLFAAVSANGLVANVFTYTIMMKNLIKEGSVEEADDLFLSMEKSGCTADSYMLNLIVRMLLEKGELVKAGNYMSKVDAMSYSLEAETVSLLISLFSGKGKYREHIGLLPAKYQFREEAATIV

SEQ ID NO: 242 - protein, 786 aa, Triticum aestivum
MPRFSSTTPMSPLRRRLRARHSSSTSHSSRSWEPHAAFAAAAERARSGNLTPEDAHHLFDELLRQGNPVQDRPLNKLLSALARAPASAACRNGPALAVALFSRISQGARRRVAEPTACTYGILMDCCCRAHRLDLTLAFFGGLLKTGLKAGVIQVCTLLKGLCRAKRADEALDVLLHRMPELGCTPNVVAYTTVIHGFFKEGQVGKACNLFHGMAQQGVAPNLVTYNSVIDALCKAKAMDKAEYFLGQMVDDGVVPDNVTYNSLIHGYSSSGHWKEAVRVFKEMTSRRVTADVHTYNMFMTFLCKHGRSKEAAGIFDTMALKGLKPDNVSYAILLHGYATEGCLVDMINLFNSMERDCILPDCRIFNILINAYAKSGKLDKAMLIFNEMQKQGVSPNAVTYSTVIDAFCKKGQLDDAMIKFNQMIDTGVRQGTAVYGSLIQGFCTHGDLVKAKELLTEMMNKGLSPPDIKFFHSIMQNLGTEGRVIEARDVLGLIAHIGMRPNVCTFNILIGGYCLVGKMEDASKIFDDMMSYGLEPSNITYGILINGYCKNERINDGLILFKEMLRKGLKPTTFNYNVILDGLFLTGRTVAAKEKFDEMVESGVSVCIDTYSIVLGGLCRNNCSGEAITLFQKLSTMDVKFNITIVNIMIDAFYRVQRNQEAKDLFAAVSANGLVANVFTYTIMMKNLIKEGSVEEADNLFLSMEKSGCTADSYMLNLIVRMLLEKGELVQAGNYMSKVDAMSYSLEAETVSLLISLFSGKGKYREHIGLLPAKYRFREEAATVV

SEQ ID NO: 243 - protein, 788 aa, Triticum aestivum
MPRFSSTTPLSPLRLRRRLRARHSSSTSHSSRSWEPHAAFAAAAERARSGNLTPEDAHHLFDELLRQGNPVQDRPLNKLLSALARAPASATCRNGPALAVALFSRISQGARRRVAEPTACTYGILMDCCCRAHRLDLVFAFFGRLLRTGLKAGVIQVCTLLKGLCRAKRADEALDVLLHRMPELGCTPNVVAYTTVIHGFFKEGQVGKACNLFHGMAQQGVAPNLVTYNSVIDALCKAKAMDKAEYFLGQMVDDGVVPDNVTYNSLIHGYSSSGHWKEAVRVFKEMTSRRVTADVHTYNMFMTFLCKHGRSKEAAGIFDTMAMKGLKPDNVSYAILLHGYATEGCLVDMINLFNSMERDCILPDCRIFNILINAYAKSGKLDKAMLIFNEMQKQGANPDAVTYSTVIDAFCKKGQLDDAMIKFNQMIDTGVPQGTAVYGSLIQGFCTHGDLVKAKELVTEMMNKGIPPPDIKFFHSIMQNLCTEGRVIEARDVLGLIAHIGMKPNVCTFNILSGGYCLVGKMEDASKIFDDMMSYGLEPSNITYGILINGYCKNERINDGLILFKEMLCKGLKPTTFNYNVILDGLFLTGRTVAAKEKFDEMVESGVSVCIDTYSIVLGGLCRNNCSGEAIMLFQKLSTMDVKFNITIVNIMIDAFYRVQRNQEAKDLFAAVSANGLVANVFTYTIMMKNLIKEGSVEEADDLFLSMEKSGCTADSYMLNLIVRMLLEKGELVKAGNYMSKVDAMSYSLEAETVSLLISLFSGKGKYREHIGLLPAKYQFREEAATIV

SEQ ID NO: 244 - protein, 823 aa, Triticum aestivum
MSRLRLRHCSTTPMSRLRRRRRLSSSTSRPTPSWSPRAAFAAATERVRDGTLGPQDAHHLFDELFQQATPVPERPLNGFLAALTRATPSEACRDGPALALSLFNRVCREEAGMRVAPPTIFTYGVLMNCCCNTRRPELGLAFFGRLLRTGLKADKTVANTVLKCLCCAKRTDDAVKVLLHRMTELGCVPDAFSYAIVLKSLCDDNRSQQALDLLRMMAKEEGVCSPDVVTYNTVIHGFFKEGKIGKACNLFHEMTKQGFVPNVVTYNSVINALCKARAMDNAELFLRQMVDNGVQPNKVTYTSMIHGYSTLGRWKEATKLFREMTSSGLIPDIVTWNSFIDSLCKHGRSKEAAEIFDSMAAKGHRPNIVTYGILLHGYAREGCFADMMSLFNSMEGDGIVANCLVFTILIDAYAKRGMMDEAMLILTEMQGQGLSPDVFTYSTLISALCRKGRLADAMDKLSEMIGTGVQPNTVVYHSLIQGFCTHGDLVKAKELVYEMMTKGIPCPNTAFFSSIVHSLCKEGRVMDAHHIFDLVKDIGERSDIIMFNTLIDGYCLVGEMGKAFSVLDVMISAGIEPDIFTYNTLVNGYFKSGRIDDGLNLFREMSHKEIKPTTVTYNIILDGLFRAGRTVAAKKMLHEMIGCGTTVSLSTYTIILRGLCRNNCTDEAIVMFQKLRTINVKFNITTLNTMINSMYTVQRREEAKDLFAAISDSGLVPNASTYGIMIRNLLKEGSVEEADNMFSSMEKSGCAPCSRLLNDTIRTLLEKGEIVKAGNYMSKVDGKSISLEASTSSLLLSLFSGKGKYREQIQLLPVKYQFFDGVS

SEQ ID NO: 245 - protein, 823 aa, Triticum aestivum
MSRLRLRHCSTTPMSRLRRRRRLSSSTSRPTPSWSPRAAFAAATERVRDGTLGPQDAHHLFDELFQQATPVPERPLNGFLAALTRATPSEACRDGPALALSLFNRVCREEAGMRVAPPTIFTYGVLMNCCCHTRRPELGLAFFGRLLRTGLKADKTVANTVLKCLCCAKRTDDAVKVLLHRMTELGCVPDAFSYAIVLKSLCDDNRSQQALDLLRMMAKEEGVCSPDVVTYNTVIHGFFKEGKIGKACNLFHEMTKQGFVPNVVTYNSVINALCKARATDNAELFLRQMVDNGVQPNKVTYTSMIHGYSTLGRWKEATKLFREMTSSGLIPDIVTWNSFIDSLCKHGRSKEAAEIFDSMAAKGHRPNIVTYGILLHGYAREGCFADMMSLFNSMEGDGIVANCLVFTILIDAYAKQGMMDEAMLILTEMQGQGLSPDVFTYSTLISALCRKGKLADAMDKLSEMIGTGVQPNTVVYHSLIQGFCTHGDLVKAKELVYEMMTKGIPCPNTAFFSSIVHSLCKEGRVMDAHHIFDLVKDIGERSDIIMFNTLIDGYCLVGEMGKAFSVLDVMISAGIEPDIFTYNTLVNGYFKSGRIDDGLNLFREMSHKEIKPTTVTYNIILDGLFRAGRTVAAKKMLHEMIGCGTTVSLSTYTIILRGLCRNNCTDEAIVMFQKLRTINVKFNITTLNTMINSMYTVQRREEAKDLFAAISDSGLVPNASTYGIMIRNLLKEGSVEEADNMFSSMEKSGCAPCSRLLNDTIRTLLEKGEIVKAGNYMSKVDGKSISLEASTSSLLLSLFSGKGKYREQIQLLPVKYQFFDGVS

SEQ ID NO: 246 - protein, 823 aa, Triticum aestivum; identical to SEQ ID NO: 244

SEQ ID NO: 247 - protein, 823 aa, Triticum aestivum; identical to SEQ ID NO: 244

SEQ ID NO: 248 - protein, 823 aa, Triticum aestivum; identical to SEQ ID NO: 245

SEQ ID NO: 249 - protein, 823 aa, Triticum aestivum
MSRLRLRHCSTTPMSRLRRRRRLSSSTSRPTPSWSPRAAFAAATERVRDGTLGPQDAHHLFDELFQQATPVPERPLNGFLAALTRATPSEACRDGPALALSLFNRVCREEAGMRVAPPTIFTYGVLMNCCCHTRRPELGLAFFGRLLRTGLKADKTVANTVLKCLCCAKRTDDAVKVLLHRMTELGCVPDAFSYAIVLKSLCDDNRSQQALDLLRMMAKEEGVCSPDVVTYNTVIHGFFKEGKIGKACNLFHEMTKQGFVPNVVTYNSVINALCKARATDNAELFLRQMVDNGVQPNKVTYTSMIHGYSTLGRWKEATKLFREMTSSGLIPDIVTWNSFIDSLCKHGRSKEAAEIFDSMAAKGHRPNIVTYGILLHGYAREGCFADMMSLFNSMEGDGIVANCLVFTILIDAYAKRGMMDEAMLILTEMQGQGLSPDVFTYSTLISALCRKGKLADAMDKLSEMIGTGVQPNTVVYHSLIQGFCTHGDLVKAKELVYEMMTKGIPCPNTAFFSSIVHSLCKEGRVMDAHHIFDLVKDIGERSDIIMFNTLIDGYCLVGEMGKAFSVLDVMISAGIEPDIFTYNTLVNGYFKSGRIDDGLNLFREMSHKEIKPTTVTYNIILDGLFRAGRTVAAKKMLHEMIGCGTTVSLSTYTIILRGLCRNNCTDEAIVMFQKLRTINVKFNITTLNTMINSMYTVQRREEAKDLFAAISDSGLVPNASTYGIMIRNLLKEGSVEEADNMFSSMEKSGCAPCSRLLNDTIRTLLEKGEIVKAGNYMSKVDGKSISLEASTSSLLLSLFSGKGKYREQIQLLPVKYQFFDGVS

SEQ ID NO: 250 - protein, 819 aa, Triticum aestivum
MPRLRRFSTMPMLHLLRRSSSSTSTSPPLRSWSPHAAFAAATERVRAGALSPEDAHHLFDELLRQATPVPERSLNGFLAALARAPASAACIRDGPALAVALFNRVCREEAGLQVAAPTVCTYNILMGCCCRVHRPDLGLAFFGRLLRTGLKTEQITANTFLKCLCYAKRTEEAVNMLLHGMSELGCVPDAISYSIVLKSLCENSMSQRAFDLLHSGHSTCSFSVVAYSTVIHGFFKEGKTGKACNLFHEMIHQGVDPDVVTCNSIINALCKARAMDKAELVLRQMVDKGVQPNTVTYNCMIHGYSTSGRLKEAVKMLTEMTSRGLIPDIVTYNSLMTSLSKHRRSKEAAEIFYSMTAKGHKPNAASHRILLNGYATEGCFADMIDLFNSMESNGFVADCHVFTILIDAYAKRGMMDEAMLIFTEMREKGVSPDVFTYYTVIAALCRLGRLADAMDRFNEMTDMGVQPNTVVYHSLIQGFCMLGDLVKAKELVSEMMNKGIPRPDIAFFSSIINSLCKEGRVMDAQDIFELVISIDERPDVITFNSLIDGYGLIGQMDKAFGVLDAMVSAGIEPNVVTYSSLLDGYCRNGRIDDALILFREMPRKRIKPNTVTYGIILHGLFRAGRTVAARKMFDEMIEGGIPVSISIYNIILGGLCRNNCADEAITLFQKLGAMNVKFDIITLNTMINAMFKVRRREEANDLFAAISASGLVPNASTYGIMIENILKEGSVEEVDNMFSSMEKSGCAPSSRLINCIIRMLLEKGEIARAGNYLSKVDGKIISLEASTTSLLLSLFSREGKYRENIELLPAKYQFFIGFG

SEQ ID NO: 251 - protein, 570 aa, Triticum aestivum
MIHQGVDPDVVTYNSIIDGLCKARAMDKAELVLRQMVDKGVQPNTVTYNCMIHGYSTSGRLKEAVKMLTEMTSRGLIPDIVTYNSLMTSLCKHGRSKEVAEIFYSMTAKGHKPNAASYRILLNGYATEGCFADMIDLFNSRESNSFVSDCHVFTILIDAYAKRGMMDEAMLIFTEMREKGVSPDVFTYYTVIAALCRLGRLADAMDRFNEMTDMGVQPNTVVYHSLIQGFCMLGDLVKAKELVSEMMNKGIPRPDIAFFSSIINSLCKEGRVMDAQDIFELVISIDERPDVITFNSLIDGYGLIGQMDKAFGVLDAMVSAGIEPNVVTYSSLLDGYCRNGRIDDALILFREMPRKRIKPNTVTYGIILDGLFRAGRTVAARKMFDEMIEGGIPVSISIYNIILGGLCRNNCADEAITLFQKLGAMNVKFYIITLNTMINAMFKVRRREEANDLFAAISASGLVPNASTYGIMIENILKEGSVEEVDNMFSSMEKSDCAPSSRLINYIIRMLLEKGEIARAGNYLSKVDGKIISLEASTTSLLLSLFSREGKYRENIELLPAKYQFFNGFG

SEQ ID NO: 252 - protein, 570 aa, Triticum aestivum; identical to SEQ ID NO: 251

SEQ ID NO: 253 - protein, 397 aa, Triticum aestivum
MIHQGVDPDVVTYNSIIDGLCKARAMDKAELVLRQMVDKGVQPNTVTYNCMIHGYSTSGRLKEAVKMLTEMTSRGLIPDIVTYNSLMTSLCKHGRSKEAAEIFYSMTAKGHKPNAASYRILLNGYATEGCFADMIDLFNSMKSNGFVADCHVFTILIDAYAKRGMMDEAMLIFTEMREKGVSPDVFTYYTVIAALCRLGRLADAMDRFNEMTDMGVQPNTVVYHSLIQGFCMLGDLVKAKELVSEMMNKGIPRPDIAFFSSIINSLCKEGRVMDAQDIFELVISIDERPDVITFNSLIDGYGLIGQMDKAFGVLDAMVSAGIEPNVVTYSSLLDGYCRNGRIDDALILFREMPRKRIKPNTVTYGIILDGLFSAGRTVAARKMFDEMIEGGKPSSRC

SEQ ID NO: 254 - protein, 819 aa, Triticum aestivum
MPRLRRFSTMPMLHLLRRSSSSTSTSPPLRSWSPHAAFAAATERVRAGALSPEDAHHLFDELLRQATPVPERSLNGFLAALARAPASAACIRDGPALAVALFNRVCREEAGLQVAAPTVCTYNILMGCCCRVHRPDLGLAFFGRLLRTCLKTEQITANTFLKCLCYAKRTEEAVNMLLHGMSELGCVPDAISYSIVLKSLCENSMSQRAFDLLHSGHSTCSFSVVAYSTVIHGFFKEGKTGKACNLFHEMIHQGVDPDVVTYNSIINALCKARAMDKAELVLRQMVDKGVQPNTVTYNCMIHGYSTSGRLKEAVKMLTEMTSRGLIPDIVTYNSLMTSLSKHRRSKEAAEIFYSMTAKGHKPNAASYRILLNGYATEGCFADMIDLFNSMESNGFVADCHVFTILIDAYAKRGMMDEAMLIFTEMREKGVSPDVFTYYTVIAALCRLGRLADAMDRFNEMTDMGVQPNTVVYHSLIQGFCMLGDLVKAKELVSEMMNKGIPRPDIAFFSSIINSLCKEGRVMDAQDIFELVISIDERPDVITFNSLIDGYGLIGQMDKAFGVLDAMVSAGIEPNVVTYSSLLDGYCRNGRIDDALILFREMPRKRIKPNTVTYGIILHGLFRAGRTVAARKMFDEMIEGGIPVSISIYNIILGGLCRNNCADEAITLFQKLGAMNVKFDIITLNTMINAMFKVRRREEANDLFAAISASGLVPNASTYGIMIENILKEGSVEEVDNMFSSMEKSGCAPSSRLINCIIRMLLGKGEIARAGNYLSKVDGKIISLEASTTSLLLSLFSREGKYRENIELLPAKYQFFIGFG

SEQ ID NO: 255 - protein, 570 aa, Triticum aestivum
MIHQGVDPDVVTYNSIIDGLCKARAMDKAELVLRQMVDKGVQPNTVTYNCMIHGYSTSGRLKEAVKMLTEMTSRGLIPDIVTYNSLMTSLCKHGRSKEAAEIFYSMTAKGHKPNAASYRILLNGYATEGCFADMIDLFNSMKSNGFVADCHVFTILIDAYAKRGMMDEAMLIFTEMREKGVSPDVFTYYTVIAALCRLGRLADAMDRFNEMTDMGVQPNTVVYHSLIQGFCMLGDLVKAKELVSEMMNKGIPRPDIAFFSSIINSLCKEGRVMDAQDIFELVISIDERPDVITFNSLIDGYGLIGQMDKAFGVLDAMVSAGIEPNVVTYSSLLDGYCRNGRIDDALILFREMPRKRIKPNTVTYGIILDGLFRAGRTVAARKMFDEMIEGGIPVSISIYNIILGGLYRNNCADEAITLFQKLGAMNVKFYIITLNTMINAMFKVRRREEANDLFAAISASGLVPNASTYGIMIENILKEGSVEEVDNMFSSMEKSDCAPSSRLINYIIRMLLEKGEIARAGNYLSKVDGKIISLEASTTSLLLSLFSREGKYRENIELLPAKYQFFNGFG

SEQ ID NO: 256 - protein, 570 aa, Triticum aestivum; identical to SEQ ID NO: 255

SEQ ID NO: 257 - protein, 819 aa, Triticum aestivum; identical to SEQ ID NO: 250

SEQ ID NO: 258 - protein, 819 aa, Triticum aestivum
MPRLRRFSTMPMLHLLRRSSSSTSTSPPLRSWSPHAAFAAATERVRAGALSPEDAHHLFDELLRQATPVPERSLNGFLAALARAPASAACIRYGPALAVALFNRVCREEAGLQVAAPTVCTYNILMGCCCRAHRPDLGLAFFGRLLRTGLKTEQITANTFLKCLCYAKRTEEAVNVLLHGMSELGCVPDAISYSIVLKSLCENSMSQRALDLLHSGHSTCSFSVVAYSTVIHGFFKEGKTGKACNLFHEMIHQGVDPDVVTYNSIINALCKARAMDKAELVLRQMVDKGVQPNTVTYNCMIHGYSTSGRLKEAVKMLTEMTSRGLIPDIVTYNSLMTSLCKHRRSKEAAEIFYSMTAKGHKPNAASYRILLNGYATEGCFADMIDLFNSMESNGFVADCHVFTILIDAYAKRGMMDEAMLIFTEMREKGVSPDVFTYYTVIAALCRLGRLADAMDRFNEMTDMGVQPNTVVYHSLIQGFCMLGDLVKAKELVSEMMNKGIPRPDIAFFSSIINSLCKEGRVMDAQDIFELVISIDERPDVITFNSLIDGYGLIGQMDKAFGVLDAMVSAGIEPNVVTYSSLLDGYCRNGRIDDALILFREMPRKRIKPNTVTYGIILHGLFRAGRTVAARKMFDEMIEGGIPVSISIYNIILGGLCRNNCADEAITLFQKLGAMNVKFDIITLNTMINAMFKVRRREEANDLFAAISASGLVPNASTYGIMIENILKEGSVEEVDNMFSSMEKSGCAPSSRLINCIIRMLLEKGEIARAGNYLSKVDGKIISLEASTTSLLLSLFSREGKYRENIELLPAKYQFFIGFG

SEQ ID NO: 259 - protein, 819 aa, Triticum aestivum; identical to SEQ ID NO: 250

SEQ ID NO: 260 - protein, 819 aa, Triticum aestivum; identical to SEQ ID NO: 250

SEQ ID NO: 261 - protein, 465 aa, Triticum aestivum
  misc_feature (17)..(21): Xaa can be any naturally occurring amino acid
MTAKGHKPNAASHRILXXXXXTEGCFADMIDLFNSMESNGFVADCHVFTILIDAYAKRGMMDEAMLIFTEMREKGVSPDVFTYYTVIAALCRLGRLADAMDRFNEMTDMGVQPNTVVYHSLIQGFCMLGDLVKAKELVSEMMNKGIPRPDIAFFSSIINSLCKEGRVMDAQDIFELVISIDERPDVITFNSLIDGYGLIGQMDKAFGVLDAMVSAGIEPNVVTYSSLLDGYCRNGRIDDALILFREMPRKRIKPNTVTYGIILDGLFRAGRTVAARKMFDEMIEGGIPVSISIYNIILGGLYRNNCADEAITLFQKLGAMNVKFYIITLNTMINAMFKVRRREEANDLFAAISASGLVPNASTYGIMIENILKEGSVEEVDNMFSSMEKSDCAPSSRLINYIIRMLLEKGEIARAGNYLSKVDGKIISLEASTTSLLLSLFSREGKYRENIELLPAKYQFFNGFG

SEQ ID NO: 262 - protein, 570 aa, Triticum aestivum; identical to SEQ ID NO: 251

SEQ ID NO: 263 - protein, 819 aa, Triticum aestivum; identical to SEQ ID NO: 250

SEQ ID NO: 264 - protein, 502 aa, Triticum aestivum
MLDIGVVKDRRRRRRNNGARNDTGDRNCCCMETMMPGRSLNGFLAALARATSSAAPACIRDGPVLVVALFNRLCREQAVVRVAPLTVHTYGILMDCCCRTSRPDLGLAFFGRLLRTGLKTNEIVATTFLKCLCYAKRTDEAVNVLLHRMPELGCVPDAFAYSTVLKSLCDNSMSQQGLDLLHMMAKEGGGCSPNVVAYSTVIHGFFKEGEIGKACNLFHEMMQQGVEPNVWTYSSIIDALCKARAMDKAELVLQQMVNKGVQPNNVTYSCMIHGYSTSGRWKEAAKLLREMKSRGLILDIVTRNSFLASLCKHGRSKEAAEFLDSMTAKGHKPDIVSYCILLHGYGTEGCFADMIDVFYSMESNGIAADCHVFNILINGYAKRGMTEEAMLIFTEMRGQGVSPDVVTYSIVIAALSRMGKLTDAIEKFNEMTALEVQPDTTVYHSLIQGCCIDGDLVKAKELMFEMMNGGIPRPNIVFFNSVINSLCKEGRVMDAHDVLDLL

SEQ ID NO: 265 - protein, 264 aa, Triticum aestivum
MDKAFKILDVMESVGVEPNVVTYSTLLDGYSKNRRIDDALTLFREMPRKRIKPDTVTYGIMLDGLFRAGRTVAAMEMFHEMIESGTTVDILIYNIKLGGLCRHNCVDEAIALFQKLRAMNVKFNIEILNTMINAMYKVQRKEEAKELFATISANGLVPNESTYAVMIRNLLKDGAVEDADNMFSSMDNSGIVPSSRLINDIIRMLLEKGEIAKAGNYLSKVDGKSISLEASTTSLMLSLFSRKGKHQEDIKLLPAKYQIFDGFS

SEQ ID NO: 266 - protein, 822 aa, Triticum aestivum
MAEIRPKSTFCGRKSKHTVGVEVEEELRRRRRMLDIGVVKDRRRRRRNNGARNDTGDRNCCCMETMMPGRSLNGFLAALARATSSAAPACIRDGPVLVVALFNRLCREQAVVRVAPLTVHTYGILMDCCCRTSRPDLGLAFFGRLLRTGLKTNEITATTFLKCLCYAKRTDEAVNVLLHRMPELGCVPDAFAYSTVLKSLCDNSMSQQGLDLLHMMAKEGGGCSPNVVAYSTVIHGFFKEGEIGKACNLFHEMMQQGVEPNVWTYSSIIDALCKARAMDKAELVLQQMVNKGVQPNNVTYSCMIHGYSTSGRWKEAAKLLREMKSRGLILDIVTRNSFLASLCKHGRSKEAAEFLDSMTAKGHKPDIVSYCILLHGYGTEGCFADMIDVFYSMESNGIAADCHVFNILINGYAKRGMTEEAMLIFTEMRGQGVSPDVVTYSIVIAALSRMGKLTDAIEKFNEMTALEVQPDTTVYHSLIQGCCIDGDLVKAKELMFEMMNGGIPRPNIVFFNSVINSLCKEGRVMDAHDVLDLVIGIGERPNVITFNSLIDGYCLVGNMDKAFKILDVMESVGVEPNVVTYSTLLDGYSKNRRIDDALTLFREMPRKRIKPDTVTYGIMLDGLFRAGRTVAAMEMFHEMIESGTTVDILIYNIKLGGLCRNNCVDEAIALFQKLRAMNVKFNIEILNTMINAMYKVQRKEEAKELFATISANGLVPNESTYAVVIRNLLKGGAVEDADNMFSSKDNSGIVPSSRLINDIIRMLLEKGEIAKAGNYLSKVDGKSISLEASTASLMLSLFSRKGKHQEDIKLLPAKYQFFDGFG

SEQ ID NO: 267 - protein, 502 aa, Triticum aestivum; identical to SEQ ID NO: 264

SEQ ID NO: 268 - protein, 264 aa, Triticum aestivum; identical to SEQ ID NO: 265

SEQ ID NO: 269 - protein, 822 aa, Triticum aestivum; identical to SEQ ID NO: 266

SEQ ID NO: 270 - protein, 822 aa, Triticum aestivum; identical to SEQ ID NO: 266

SEQ ID NO: 271 - protein, 502 aa, Triticum aestivum; identical to SEQ ID NO: 264

SEQ ID NO: 272 - protein, 264 aa, Triticum aestivum; identical to SEQ ID NO: 265

SEQ ID NO: 273 - protein, 392 aa, Triticum aestivum
MSQQGLDLLHMMAKEGGGCSPNVVAYSTVIHGFFKEGEIGKACNLFHEMMQQGVEPNVWTYSSIIDALCKARAMDKAELVLQQMVNKGVQPNNVTYSCMIHGYSTSGRWKEAAKLLREMKSRGLIPDIVTRNSFLASLCKHGRSKEAAEFLDSMTAKGHKPDIVSYCILLHGYGTEGCFADMIDLFNSMESNGIAADCHVFNILINGYAKRGMTEEAMLIFTEMRGRVSPDVVTYSIVIAALSRMGKLTDAIEKFNEMTALEVQPDTTVYHSLIQGCCIDGDLVKAKELMFEMMNGGIPRPNIVFFNSVINSLCKEGRVMDAHDVLDLVIGIGERPNVITFNSLIDGYCLVGNMDKAFKILDVMESVGVEPNVVTYSAILMAILKTEGLMML

SEQ ID NO: 274 - protein, 769 aa, Triticum aestivum
MPAARLSSFKAPSRERRPPLAALAAATERVRAGTLSRQDAHHLFDELLSQAATVPVRKLNNFLAALARAPPSAACSDGPGLAIALFNRMSRGAGARVVSPTLCTYSILMDCCCRARRPDLVVAFFGRLLRLGLRLEVISFNNLLKGLCQAKRSNEALDMLLHRTPELHCAPDVFSYNIVINGCLKEGEVDKACNLFHEMPQLGVQPDVVTYTSIMDALSKSGAMDKAEVLLRQMVDQGIEPNIKTYSYLIHGYSTFGQWKEALRVFKEMASLGVVPDVVTLTSLIDSLCKHRRTKEAREIFDSMAAKGLKPNIVSYSTMPNGYVKEGSFEDMTDLFNSMVRNGIVPNHHIFNILINAYAKRGVMDEAMHMFEVMRQQGVNPDVFDYQIIMDSLCKMGRMDAALDKFNQMVNQGVSPNKAVYQCLVLGSCSHGHFVKAKELISEVVNRGLCSNTVFFYPVINGLCKEGKVKEAQDMFDFILGIGQRPDVIMYTSLMDGYCLVGEVEKALSVLDAMKSAGLQPDDVVYATLLNGYCKIGRIADGLSLFREMSLSGVKPMTIIYNIILDGLFCSGRTVCAKEKFNTMTESGIPVGVDTYNIVLSGLCRNNCTDEAIELFKKLRATNVKIDVITLTTMISAMFKTRRIEEAKDLFATISAIGFMPSVVTYSVMMTNFIKEGLLAEADDMFLTMEKASCASNSSLLNQVVRALLEKGAVVKAATYLAKLDAKQLSVEASTISLIVSLFSREGKLREHVELLPVKYQPPQSSADN

SEQ ID NO: 275 - protein, 769 aa, Triticum aestivum; identical to SEQ ID NO: 274

SEQ ID NO: 276 - protein, 406 aa, Triticum aestivum
MDEAMHMFEVMRQQGVNPDVFDYQIIMDSLCKMGRMDAALDKFNQMVNQGVSPNKAVYQCLVLGSCSHGHFVKAKELISEVVNRGLCSNSVFFYPVINGLCKEGKVKEAQDMFDFILGIGQRPDVIMYTSLMDGYCLVGEVEKALSVLDAMKSAGLQPDDVVYATLLNGYCKIGRIADGLSLFREMSLSGVKPMTIIYNIILDGLFCSGRTVCAKEKFNTMTESGIPVGVDTYNIVLSGLCRNNCTDEAIELFKKLRATNVKIDVITLTTMISAMFKTRRIEEAKDLFATISAIGLVPSVVTYSVMMTNFIKEGLLAEADDMFLTMEKASCASNSSLLNQVVRALLEKGAVVKAATYLAKLDAKQLSVEASTISLIVSLFSREGKLREHVELLPVKYQPPQSSADN

SEQ ID NO: 277 - protein, 769 aa, Triticum aestivum; identical to SEQ ID NO: 274

SEQ ID NO: 278 - protein, 275 aa, Triticum aestivum
MDGYCLVGEVEKALSVLDAMKSAGLQPDDVVYATLLNGYCKIGRIADGLSLFREMSLSGVKPTTIIYNIILDGLFCSGRTVCAKEKFNTMTESGIPVGVDTYNIVLSGLCRNNCTDEAIELFKKLRATNVKIDVITFNTMISAMFKTRRIEEAKDLFATISAIGLVPSVVTYSVMMTNFIKEGLLAEADDMFLTMEKASCAPNSSLLNQVVRALLEKGAVVKAATYLAKLDAKQLSVEASMISLIVSLFSREGKLREHVELLPVKYQPPQSSADN

SEQ ID NO: 279 - protein, 785 aa, Triticum aestivum
MSPLRLRLRLRPRLHARHSYSTSHPSRSQGWDPHAAFAAATERARSGNLTSEDAHKLFDQLLLQANPVNMRLPNDLLTALARAPASAACSNGPALALALFSRLSQGARQRVVQPTACTYGILMDCCCRANRQDLALAFFARLLRTGLKAGVIEVNTLLKGLCRAKRADEALDILLHRMPELGCTPNVVAYNTVIHGFFQEGQAGKACSLFHEMAQQGVAPSLVTYNSVIDALCKARAMDKAEYFLRQMVDDGVVPDNVTYNSLIHGYSSSGHWKEAVRVFKEMTSRRVKPIVHTHNMFMTFLCKHGRSKEAAGIFDTMAMKGLKHNNVSYAILLHGYATEGCLVDMINLFNSMERYCILPDCRIFNILINAHAKSGKLDKAMLIFNEMQKQGVSPNAVTYSTIIHAFCKKGRLDDAVIKFNQMIDTGVRQGTAVYRSLIQGFCTHGDLVKAKELLTEMMNKGMLPPDIAFFNSIMQNLCTEGRVIEARDVLGLIAHIGMRPDVCTFNILIGGYCLVGKMEHASKIFDDMMSYGLEPSNITYGILINGYCKNRRIDDGLILFKEMLHKGLKPTTFNYNVILDGLFLAGRTVAAKEKFDEMVESGVSVCIGTYSIVLGGLCRNNCSGEAITLFQKLSTMDVKFNIIIVNIMIDAFYKVQRNQEAKDLFAAVSANGLVANVFTYTIMMKNLIKEGSVEEADDLFLSMEKSSCTADSYMLNLIVRMLLGKGEIVKAGNYISKIDAKSYSLEAKTVSLLISLFSGKGKYREHIGLLPAKYRFREEAATVV

SEQ ID NO: 280 - protein, 505 aa, Triticum aestivum
MSPLRLHARRSYSTSHPPRSQGWDPHAAFAAATERARSGNLTSEDAHKLFDQLLLQANPVNMRLPNDLLTALARAPASAACSNGPALALALFSRLSQGARQRVVQPTACTYGILMDCCCRANRQDLALAFFARLLRTGLKAGVIEVNTLLKGLCRAKWADEALDILLHRMPELGCTPNVVAYNTVIHGFFQEGQAGKACSLFHEMAQQGVAPSLVTYNSVIDALCKARAMDKAEYFLRQMVDDGVIPDNVTYNSLIHGYSSSGHWKEAVRVFKEMTSRRVKPNVHTHNMFMTFLCKHGRSKEAAGIFDTMAMKGLKHNNVSYAILLHGYATEGCLVDMINLFNSMERYCILPDCRIFNILIHAHAKSGKLDKAMLIFNEMQKQGVSPNAVTYSTIIHAFCKKGRLDDAVIKFNQMIDTGVRQGTAVYRSLIQGFCTHGDLVKAKELLTEMMNKGMLPPDIAFFNSIMQNLCTEGRVIEARDVLGLIAHIGMRPDVCTFNILVDTA

SEQ ID NO: 281 - protein, 785 aa, Triticum aestivum; identical to SEQ ID NO: 279

SEQ ID NO: 282 - protein, 669 aa, Triticum aestivum
MRSSPAPSSSASSVQNGQMKLLNVLLHRTSVLGCVPNSFSYNIVLKSLCDDSRSQQALGLLQVMAKGDDCSPGVLSYSTLIHGFFKEGEVGKACNLFHEMMRQGVVPDVVTYSSIIDALCKAGAMDKAELFLRQMVDNSVRPDTVTYTSMIHGYSTLGRWKEATKMFREMTSRGLIPNIVTWNSFMASLCKHGKSKEAAEIFFSMAARGHKPDIISYTILLHGYANEGSFADMMNLFNSMVGDGIVANCQVFNILIDAYAKQRMMDEAMIILNKMRGQGLSPDVFTYSTLVSALCKMVRLADAMGKFSQMIGRGVQPNTVVYHSVVQGLCTHGVLVKAKELVNEMMNKGMLRPNIAFFNSIMDNLCNEGRVVDAHHIFDLITDIGEKPDVITFSTLIDGYCLVGEMEKACGVLDAMVSAGIEPDVITYNTLVSGYCKSGRIDDGLNLFREMFHMEVKPTTVTYNIILDGLFHAGRTVAAKKMLHEMIGSGTPVSMHTYDIFIRGLCRNDCTDEAIALFQKLGALNVKFDIAILNSMINAMYKVQRREEANKLFAAISTSGLVPNASTYGIMIRNLLKEGSVEEAEDMFSSMEKSDCALSSRLINDIIRMLLEKGEIVKAGEYMSKVDGKSISLEASTSSLLLSLFSGKGKYREQIQLLPAKYQFFDGTI

SEQ ID NO: 283 - protein, 669 aa, Triticum aestivum; identical to SEQ ID NO: 282

SEQ ID NO: 284 - protein, 812 aa, Triticum aestivum
MSCLHLLRRRTSSFTPTSPPSRSWSPHAAFAAATERVRAGTLTPQDAHHLFDQLLRQSTPVPGQALNGFLAGLARARDTDACRDGPSLALTLFNRVCREEAGRRVAPPTIYTYGILMNCCCHVRRPDLGLAYFGRLLRTGLNTNEVVASTLLKCLCCAKRADEAVNVLLHRTSVLGCVPNSFSYNIVLKSLCDDSRSQQALGLLQVMAKGDDCSPGVLSYRTLIHGFFKEGEVGKACNLFHEMMRQGVVPDVVTYSSIIDALCKAGAMDKAELFLRQMVDNSVRPDTVTYTSMIHGYSTLGRWKEATKMFREMTSRGLIPNIVTWNSFMASLCKHGKSKEAAEIFFSMAARGHKPDIISYTILLHGYANEGSFADMMNLFNSMVGDGIVANCQVFNILIDAYAKQGMMDEAMIILNKMRGQGLSPDVFTYSTLVSALCKMGRLADAMGKFSQMIGRGVQPNTVVYHSLVQGLCTHGVLVKAKELVNEMMNKGMLRPNIAFFNSIMDNLCNEGRVVDAHHIFDLVTDIGEKPDVITFTTLIDGYCLVGEMEKACGVLDAMVSAGIEPDVITYNTLVSGYCKSGRIDDGLNLFREMSHMEVKPTTVTYNIILDGLFHAGRTVAAKKMLHEMIGSGTPVSMHTYDIFIRGLCRNDCTNEAIALFQKLGALNVKFDIAILNSMINAMYKVQRREEANKLFAAISTTGLVPNASTYGIMIRNLLKEGSVEEAEDMFSSMEKSDCALSSRLINDIIRMLLEKGEIVKAGEYMSKVDGKSISLEASTSSLLLSLFSGKGKYREQIQLLPAKYQFFDGTI

SEQ ID NO: 285 - protein, 669 aa, Triticum aestivum; identical to SEQ ID NO: 282

SEQ ID NO: 286 - protein, 812 aa, Triticum aestivum; identical to SEQ ID NO: 284

SEQ ID NO: 287 - protein, 812 aa, Triticum aestivum; identical to SEQ ID NO: 284

SEQ ID NO: 288 - protein, 788 aa, Triticum aestivum
MPRFSTTTPMSPPRLRLRLGARHSSSTSHPSCIWDPHAAFAAATQRARSGKLTTEDAHHLFDELLRQGNPVQERPLTNFLAALARAPASASCSDGPALAVALFGRLSRGAGRGVAQPNVFTYGVLMDCCCRARFPDLALAFFGRLLRTGLKADQVVFSTLLKGLCHAKRSDEALDVLLHRMPELGCTPDVVVYNTVIHGFFREGQAGKACDLFHGMAQQGVMPDVVTYNSVIDALCKARAMDKAEYFLRQMVDDGVVPDNVTYSSLIHGYSSSGHWKEAVRVFKEMTSRRVTPDVHTYNMFMTFLCKHGRSKEAAGIFDTMAMKGLKPDNISYAIRLHGYATEGCLVDMINLFNSMERDCILPDCRIFSILINAYAKSGKLDKAMLIFNKMQKQGVSPNAVTYSTVIDAFCKKGQLDDAMIKFNQMIDTGVRQGTAVYGSLIQGFCTHGDLVKAKELLTEMMNKGIPPPDIKFFHSIMQNLCTEGRVIEARDVFGLMAHIGIRPNVCTFNILIGGYCLVGKMEDASKIFDDMMSYGLEPSNITYGILINGYCKNERIDDGLILFKEMLRKGVKPSTFNYNIILDGLFLAGRTVAAKEKFDEMVESGVSVCIDTYSIVLGGLCRNNCSGEAIMLFQKLSTMDVKFNIIIVNIMIDAFYRVQRNQEAKDLFAAVSANGLVANVFTYTIMMKNLIKEGSVEEADDLFLSMEKSGCTADSYMLNLIVRMLLEKGELVKAGNYMSKVDAKSYSLEAETVSLLISLFSGKGKYREHIGLLPTKYQFREEAATVE

SEQ ID NO: 289 - protein, 621 aa, Triticum aestivum
MIKRDVDKITEGCRLAHSHWYNLEKHSPVVLLPVEFATYTPAMPRFSSTTPMSPPRLRLRLRLCARHSSSTSHPSRIWDPHAAFAAATERARSGNLTPEDAHHLFDELLRQGNPVQERPLTNFLAALARAPASASCSDGPALAVALFGRLSRGAGRGVAQPNVFTYGVLMDCCCRARFPDLALAFFGRLLRTGLKADQVVFSTLLKGLCHAKRSDEALDVLLHRMPELGCTPYVVAYNTVIHGFFREGQAGKACDLFHGMAQQGVMPDVVTYNSVIDALCKARAMDKAEYFLRQMVDDGVVPDNVTYSSLIHGYSSSGHWKEAVRVFKEMTSRRVTPDVHTYNMFMTFLCKHGRSKEAAGIFDTMAMKGLKPDNISYAIRLHGYATEGCLVDMINLFNSMERDCILPDCRIFSILINAYAKSGKLDKAMLIFNKMQKQGVSPNAVTYSTVIDAFCKKGQLDDAMIKFNQMIDTGVRQGTAVYGSLIQGFCTHGDLVKAKELLTEMMNKGIPPPDIKFFHSIMQNLCTEGRVIEARDVLGLMAHIGIRPNVCTFNILIGGYCLVGKMEDASKIFDDMMSYGLEPSNITYGILINGYCKNERIDDGLILFKEMLRKGVKPSKF

SEQ ID NO: 290 - protein, 792 aa, Triticum aestivum
MPRFSSSTPMSPPRLRLRLRLRLCARHSSSTSHPSRIWDPHAAFAAATQRARSGKLTTEDAHHLFDELLRQGNPVQERPLTNFLAALARAPASASCSDGPALAVALFGRLSRGAGRGVAQPNVFTYGVLMDCCCRARFPDLALAFLGRLLRTGLKADQVVFSTLLKGLCHAKRSDEALDVLLHRMPEQGCTPYVVAYNTVIHGFFREGQAGKACDLFHGMAQQGVMPDVVTYNSVIDALCKARAMDKAEYFLRQMVDDGVVPDNVTYSSLIHGYSSSGHWKEAVRVFKEMTSRRVTPDVHTYNMFMTFLCKHGRSKEAAGIFDTMAMKGLKPDNISYAIRLHGYATEGCLVDMINLFNSMERDCILPDCRIFSILINAYAKSGKLDKAMLIFNKMQKQGVSPNAVTYSTVIDAFCKKGQLDDAMIKFNQMIDTGVRQGTAVYGSLIQGFCTHGDLVKAKELLTEMMNKGIPPPDIKFFHSIMQNLCTEGRVIEARDVLGLMAHIGIRPNVCTFNILIGGYCLVGKMEDASKIFDDMMSYGLEPSNITYGILINGYCKNERIDDGLILFKEMLRKGVKPSTFNYNIILDGLFLAGRTVAAKEKFDEMVESGVSVCIDTYSIVLGGLCRNNCSGEAIMLFQKLSTMDVKFNIIIVNIMIDAFYRVQRNQEAKDLFAAVSANGLVANVFTYTIMMKNLIKEGSVEEADDLFLSMEKSGCTADSYMLNLIVRMLLEKGELVKAGNYMSKVDAKSYSLEAETVSLLISLFSGKGKYREHIGLLPTKYQFREEAATVE

SEQ ID NO: 291 - protein, 784 aa, Triticum aestivum
MPRLSSTTPMSPLRLRARHSSSTSHPSRIWDPHTAFATATERARSGNLTPEDAHHLFDELLRQANPVQERPLNNLLAALARAPASAACSDGPALAVNLFSRISEGARRRVAHPTACTYGILMDCCCRANRQDLALAFFARLLRTGLKAGVIEVNTLLKGLCRAKRADEALDILLHRMPELGCTPNVVAYNTVIHGFFREGQVGKACNLFHEMRQQGVTPDVVTYNSVIDALCKAKAMDKAEYFLGQMVDDGVVSDNVTYNSLIHGYSSSGHWKEAVRVFKEMTSRRVTPDLHTYNMFMTFLCNHGRSKEAAGIFDSMAMKGLKPDNVSYAIRLHGYATEGCLVDMINLFNSMERDCILPDCRIFSILIYAYAKSGKLDKAMLIFNEMQKQGVSPNAVTYSTVIDAFCKKGQLDDAMIKFNQMIDTGVRQGTAVYRSLIQGFCTHGDLVKAKELLTEMMNKGIPPPDIKFFHSIMQNLCTEGRVIEARDILGLIAHIGMRPNVCTFNILIGGYCLVRKMADASKVFDDMVSYGLEPCNFTYGILINGYCKNRRIDDGLILFKEMLHKGLKPTTVNYNVILDGLFLAGQTVAAKEKFDEMVESGVSVCIDTYSIVLGGLCRNSCSSEAITLFRKLSAMNVKFDIKIVNIIIGAFYRVKRNQEAKDLFAAIPANGLVPNAVTYTIMMTNLIKEGSVEEADNLFLSMEKSGSTANSWMLNHIIRRLLERGEIVKAGNYMSKVDVKSYSLEAKTVSLLISLFSREGEYRDHIKLLPIKYQFLEKPATVE

SEQ ID NO: 292 - protein, 784 aa, Triticum aestivum; identical to SEQ ID NO: 291

SEQ ID NO: 293 - protein, 788 aa, Triticum aestivum
MPRFSSTTSMSSLRLRLHARHSSSASQPSHSQGWDPHAAFAAATERARSGSLTPVDAHHLFDELLRQTNPVQEQPLNNLLAALARAPASNACRDGPALAVALFSRISQGARLRVAQPTACTYGILMDCCCRAHRLDLAFAFFGRLLRTGLKAGVIQLCTLLKGLCRAKRADEAMDVLLHRMPELGCTPNVVAYTTVIHGFLKEGQVGKACNLFHGMAQQGVAPNVVTYNSVIDALCKARAMGKAEMVLGQMVVNGVGPSNVTYNTLIHGYSSSGHQKEAVRVLKEMRSQGIIPDVFTCSSLMASLCNNGKSKEAEEILHSMVMKGLKPDIVSYSTLLHGYATEGCLVGMTNLFNSMTRYGIRPNSHAFNILINVCAKSGMMDEAMLIFKEMQKRGVSPNLVTYSTVIHAFCKMGSLDIAMDKFNQMVDIGVRPDAIVYRSLIHGFCTHGDLVKPKELVTEMRNKGMRPPDIKFFHSIMQNLCTEGRVIEARDILDLIVRIGMRPDVFIFNILIGGYCLVRKMADASKIFDDMVSYGLEPSNITYGILINGYCKNRRIDEGLILFKEMLCKGLKPTTFNYNVILDGLFLAGRTVAAKEKFDEMVESGVSVCIDTYSIFLAGLCRNNCFSEVIMLFQKLSAMNMKFNIRIVNIMIDAFYKVRRNHEAKDLFAAIPSNGLVANVVTYSIMMTNLIKEGSVEEADTLFLSMEKSGCTANSWMLNHIIRRLLERGEIVKAGNYMSKVDAKSYSLEAKTVLLLISLFSGKGKYREHIKLLPMKYQFLEEPDTVE

SEQ ID NO: 294 - protein, 788 aa, Triticum aestivum
MPRFSSTTSMSSLRLRLHARHSSSASQPSHSQGWDPHAAFAAATERARSGSLTPVDAHHLFDELLRQTNPVQEQPLNNLLAALARAPASNACRDGPALAVALFSRISQGARLRVAQPTACTYGILMDCCCRAHRLDLAFAFFGRLLRTGLKAGVIQLCTLLKGLCRAKRADEAMDVLLHRMPELGCTPNVVAYTTVIHGFLKEGQVGKACNLFHGMAQQGVAPNVVTYNSVIDALCKARAMGKAEMVLGQMVVNGVGPSNVTYNTLIHGYSSSGHQKEAVRVLKEMRSQGIIPDVFTCSSLMASLCNNGKSKEAEEILHSMVMKGLKPDIVSYSTLLHGYATEGCLVGMTNLFNSMTRYGIRPNSHAFNILINVCAKSGMMDEAMLIFKEMQKRGVSPNLVTYSTVIHAFCKMGSLDIAMDKFNQMVDIGVRPDAIVYRSLIHGFCTHGDLVKPKELVTEMRNKGMRPPDIKFFHSIMQNLCTEGRVIEARDILDLIVRIGMRPDVFIFNILIGGYCLVRKMADASKIFDDLVSYGLEPSNITYGILINGYCKNRRIDEGLILFKEMLCKGLKPTTFNYNVILDGLFLAGRTVAAKEKFDEMVESGVSVCIDTYSIFLAGLCRNNCFSEVIMLFQKLSAMNMKFNIRIVNIMIDAFYKVRRNHEAKDLFAAIPSNGLVANVVTYSIMMTNLIKEGSVEEADTLFLSMEKSGCTANSWMLNHIIRRLLERGEIVKAGNYMSKVDAKSYSLEAKTVLLLISLFSGKGKYREHIKLLPMKYQFLEEPDTVE

SEQ ID NO: 295 - protein, 790 aa, Triticum aestivum
MPRFSSTTPMASLRLRLRLHARNYSSASQPSHGQGWDPHAAFAAATERARSGSLTPADAHHLFDELLRQANPVQERPLNNLLAAIARAPASNACRNGPALAVALFSRISQGARLWVVQPTACTYGILMDCCCRAHRLDLAFAFFGRLLRTGLKAGVIQLCTLLKGLCRAERADEAMDVLLHRMPELGCTPNVVAYTTVIHGFLKEGQVGKACNLFHGMAQQGVAPNVVTYNSFIDALCKARAMGKAEMVLGQMVVNGVGPSNVTYNTLIHGYSSSGHQKEAVRVLKEMRSQGIIPDVFTCSSLMASLCNNGKSKEAEEILHSMVMKGLKPDIVSYSTLLHGYATEGCLVGMTNLFNSMTRYGIRPNSHAFNILINVCAKSGMMDEAMLIFKEMQKRGVSPNLVTYSTVIHAFCKMGSLDIAMDKFNQMVDIGVRPDAIVYRSLIHGFCTHGDLVKPKELVTEMRNKGMRPPDIKFFHSIMQNLCTEGRVIEARDILDLIVRIGMRPDVFIFNILIGGYCLVRKMADASKIFDDMVSYGLEPSNITYGILINGYCKNRRIDEGLILFKEMLCKGLKPTTFNYNVILDGLFLAGRTVAAKEKFDEMVESGVSVCIDTYSIFLAGLCRNNCFSEVIMLFQKLSAMNMKFNIRIVNIMIDAFYKVRRNHEAKDLFAAIPSNGLVANVVTYSIMMTNLIKEGSVEEADTLFLSMEKSGCTANSWMLNHIIRRLLERGEIVKAGNYMSKVDAKSYSLEAKTVLLLISLFSGKGKYREHIKLLPMKYQFLEEPDTVE

SEQ ID NO: 296 - protein, 815 aa, Triticum aestivum
MSTSSSTCSLVQLGKALHSSCSRFHHAMPRLSSTTPMSPPHLRLRLGARHSSSTSHLSRIWDPHAAFAAATERVRSGSLTPADAHHLFDELLRQTNPVQEQPLNNLLAALARAPASNACRDGPALAVALFSRISQGARLWVVQPTACTYGILMDCCCRAHRLDLAFAFFGRLLRTGLKAGVIQLCTLLKGLCRAERADEAMDVLLHRMPELGCTPNVVAYTTVIHGFLKEGQVGKACNLFHGMAQQGVAPNVVTYNSVIDALCKARAMGKAEMVLGQMVVNGVGPSNVTYNTLIHGYSSSGHQKEAVRVLKEMRSQGIIPDVFTCSSLMASLCNNGKSKEAEEILHSMVMKGLKPDIVSYSTLLHGYATEGCLVGMTNLFNSMTRYGIRPNSHAFNILINVCAKSGMMDEAMLIFKEMQKRGVSPNLVTYSTVIHAFCKMGSLDIAMDKFNQMVDIGVRPDAIVYRSLIHGFCTHGDLVKPKELVTEMRNKGMRPPDIKFFHSIMQNLCTEGRVIEARDILDLIVRIGMRPDVFIFNILIGGYCLVRKMADASKIFDDMVSYGLEPSNITYGILINGYCKNRRIDEGLILFKEMLCKGLKPTTFNYNVILDGLFLAGRTVAAKDKFDEMVESGVSVCIDTYSIFLAGLCRNNCFSEVIMLFQKLSAMNMKFNIRIVNIMIDAFYKVRRNQEAKDLFAAIPSNGLVANVVTYSIMMTNLIKEGSVEEADTLFLSMEKSGCTANSWMLNHIIRRLLERGEIVKAGNYMSKVDAKSYSLEAKTVLLLISLFSGKGKYREHIKLLPMKYQFLEEPDTVE

SEQ ID NO: 297 - protein, 792 aa, Triticum aestivum
MPRFSSTTPMSPLRLRLRLRLRLGARHSSSTSHSSRSWDPHSAFAAAAERARSGNLTPEDAHHLFDELLRQGNPIQDRPLNKLLSALARAPASATCRNGPALAVALFSRISQGARRRVAEPTACTYGILMDCCCRAHRLDLVFAFFGRLLRTGLKAGVIQVCTLLKGLCRAKRADEALDVLLHRMPELGCTPNVVAYTTVIHGFFKEGQVGKACNLFHGMAQQGVAPNLVTYNSVIDALCKAKAMDKAEYFLGQMVDDGVVPDNVTYNSLIHGYSSSGHWKEAVRVFKEMTSRRVTADVHTYNMFMTFLCKHGRSKEAAGIFDTMAMKGLKPDNVSYAILLHGYATEGCLVDMINLFNSMERDCILPDCRIFNILINAYAKSGKLDKAMLIFNEMQKQGVSPNAVTYSTVIDAFCKKGQLDDAMIKFNQMIDTGVRQGTAIYGSLIQGFCTHGDLVKAKELATEMMNKGIPPPDIKFFHSIMQNLCTEGRVIEARDVLGLIAHIGMRPNVCTFNILIGGYCLVGKMEDASKIFDDMMSYGLEPSNITYGILINGYCKNERINDGLILFKEMLRKGLKPTTFNYNVILDGLFLAGRTVAAKEKFDEMVEFGVSVCIDTYSIVLGGLCRNNCSGEAITLFQKLSTIDVKFNITIVNIMIDAFYRVQRNQEAKDLFAAVSANGLVANVFTYTIMMKNLIKEGSVEEADDLFLSMEKSGCTADSYMLNLIVRMLLGKGEIVKAGNYISKIDAKSYSLEAKTVSLLISLFSGKGKYREHIGLLPAKYRFREEAATVV

SEQ ID NO: 298 - protein, 268 aa, Triticum aestivum
MPRFSAATPMSPLRLRLRLRARHSSSTSHSSRSWDPHSAFAAAAERARSGNLTPEDAHHLFDELLRQGNPVQDRPLNKLLSALARAPASATCRNGPALAVALFSRISQGARRRVAEPTACTYGILMDCCCRAHRLDLVFAFFGRLLRTGLKAGVIQVCTLLKGLCRAKRADEALDVLLHRMPELGCTPNVVAYTTVIHGFFKEGQVGKACNLFHGMAQQGVAPNLVTYNSVIDALCKAKAMDKAEYFLGQMVDDGVVPDNVTYNSLIH

SEQ ID NO: 299 - protein, 792 aa, Triticum aestivum; identical to SEQ ID NO: 297

SEQ ID NO: 300 - protein, 790 aa, Triticum aestivum
MPRFSSTTPMSPLRLRLRLRLGARHSSSTSHSSRSWDPHSAFAATAERARSGNLTPEDAHHLFDELLRQGNPIQDRPLNKLLSALARAPASATCRNGPALAVALFSRISQGARRRVAEPTACTYGILMDCCCRAHRLDLVFAFFGRLLRTGLKAGVIQVCTLLKGLCRAKRADEALDVLLHRMPELGCTPNVVAYTTVIHGFFKEGQVGKACNLFHGMAQQGVAPNLVTYNSVIDALCKAKAMDKAEYFLGQMVDDGVVPDNVTYNSLIHGYSSSGHWKEAVRVFKEMTSRRVTADVHTYNMFMTFLCKHGRSKEAAGIFDTMAMKGLKPDNVSYAILLHGYATEGCLVDMINLFNSMERDCILPDCRIFNILINAYAKSGKLDKAMLIFNEMQKQGVSPNAVTYSTVIDAFCKKGQLDDAMIKFNQMIDTGVRQGTAIYGSLIQGFCTHGDLVKAKELATEMMNKGIPPPDIKFFHSIMQNLCTEGRVIEARDVLGLIAHIGMRPNVCTFNILIGGYCLVGKMEDASKIFDDMMSYGLEPSNITYGILINGYCKNERINDGLILFKEMLRKGLKPTTFNYNVILDGLFLAGRTVAAKEKFDEMVEFGVSVCIDTYSIVLGGLCRNNCSGEAITLFQKLSTIDVKFNITIVNIMIDAFYRVQRNQEAKDLFAAVSANGLVANVFTYTIMMKNLIKEGSVEEADDLFLSMEKSGCTADSYMLNLIVRMLLGKGEIVKAGNYISKIDAKSYSLEAKTVSLLISLFSGKGKYREHIGLLPAKYRFREEAATVV

SEQ ID NO: 301 - protein, 773 aa, Triticum aestivum
MSNTRLSSTFTSSLKAPSRKPRAPRLAALAAATERVRAGTLTRQDARQLFDELLSQAATVPVRTLNNFLAALSRAPPSAACSDGPGLAIALFNHMSQGAGARVVSPTLCTYSILMDCCCRARRPDLVVSFFGRLLRLGLRLNVISFNNLLKGLCQAKRTNEAVDLLLHRTPELDCVPNVFSYSIVINGCFKQGEVDKACNLFNQMPQLGVQPDVVIYNSIIDALSKSGAMDKAEVVLRQMVDQGIGPNVMTYTSLIHGYSASGQWKAAVRVFKEMVSVGVQPNAVALNSFMDSLCKHRRTKEARDIFDSMAAKGQKPDIFSYSTMLNGYVKEGCFDDMTGLFNLMLQNGVVRNHHIFNILINAYAKRGLMDEAMHMFEVMRQQGVNPDVFSYQIVMDSLCKMGRMDAALDKFNQMVNQGVSPNIVVYRCLVLGSCSHGDFVKAKELISEAVNRGLCSNSVFFYPVINNLSKEGKVKEAQDMFDFIVGIGQRPDVIMYHSLMDGYCLVGKVEEALRVLDAMKFAGLQPTAVTYAILLNGYCKSGRIAAGLSLFMEMSLSGVKPTTIMYNIILDGLFRSGRTVSAKEKFRTMSESGIPVGIDTYNIVLSGLCKNNCAGEAIELFKKLRAMNVKIDVKTLTIMISAMFKSRRIEEAKELFATISAIGLVPSVVTYSVMMTNFIKEGSLAEADDMFLAMEKASCAPNSILLNQVVRALLEKGVVVKAATYLAKLDAKQLSLEASTVSLILSLFSRKGKLREHVKLLPVKYQPPEMLD

SEQ ID NO: 302 - protein, 824 aa, Triticum aestivum
MSRLRHSTSTAPVPHLRLLRCRSSSISTLPPSRSSSPHAAFAAATERVSAGTLSPEDAHRLFDELLRQATPVPARSLNGFLTALSRAPDTGACRDGPALALSLFNRTRREAAGSRVVSSTIFTYGILMNCCCRTRRPELGLAFFGRVLRMGLKTNVVVATTVLQCLCGAKRTDEAVDILLHRMSELGCVPDDFSYNIVLKSLCDDSRSQRALDLLRMWENERGVCSPNVYTYNTVIHGFFKEGEVSKACNLFHEMAQKGVPPNVVTYSLTIDALCKARAMDKAQLFLRQMIHKGVRPNIVTYNVMIHGYSTLGQWKEAGKMFREMTGQGLIPDIVTWTSFMASLCKHGRTKEAAEFFDSMTAKGHKPDLVMYHVLLHGYATEGCFADMINLFNSMATKGIVPDRQVFNILIDAHAKHGMMDEAMHIFTGMQGQGVCPDVWTYSTLISALCRMGRLADAMDNFSQMIGKGVQPNTVVYHSLIQGFSTHGDLRKANELVYEMTNKGIPCPNIAFFSSIMDSLCKEGRVMDAHDIFHLVTDIGLKPNIITFNTLIDGHCLVGEMEKAFGVLDSMVSAGIEADVFTYNTLAYGYCRCGRIDDGLILFREMLQNKPKPTTITYNIILDGLFRAGRTFAAKKMFVEMIETGITVSISTYSIILGGLCRNNCSDEAITLFQKLGAMNVKFDIKILNTMINAMFKVRRREEANGLFAAISASGMVPNTSTYSVMIGNLLKEGSVEEAENMFSLMEKSGCAPDSRLINNIIRILLENGDIVKAGNYMSKVDGKSISLEASTTSLLMCLFSSKGKYREQISLLPVNYQFFNGVG

SEQ ID NO: 303 - protein, 221 aa, Triticum aestivum
MPRFSSTTPLSPLRRRLHHSSSTSHSSRSWEPHAAFAAATERARSGNLTLEDAHHLFDELLRQGNPVQDRPLNKLLSALARAPASAACRNGPALAVALFSRISQGARRRVAEPTVCTYGILMDCCCRAHRLDLALAFFGHLLKTGLEVDQVVFNTLLKGLCHAKRADEALDVLLHRMTELGCTPNVVAYNTIIHGFFKEGQVSKACNLFHEMAQQAFRLMW

SEQ ID NO: 304 - protein, 548 aa, Triticum aestivum
MDKAEVVLRQMIDRSVGPNSVTYSSLIHGYSSSGHWKEAVRVFKEMTSRRVTPNVHTYNMFITFLCKHGRSKEAAGIFDSMAMKGLKPDDVSYAILLHGYATEGSLVDMINLFNSMERDCILPDCRIFSILINAYAKSGKVDKVMLIFKKMQKQGVSPDAVTYSTLIDAFCKKGRLDDAMIKFNQMVDTGVRQGTAVYGSLIQGFCTHGDLVKGKELVTEMMNKGIPPPDIKFFHSIMQNLCTEGRVIEARDILGLIAHIGMRPNVCTFNILIGGYCLVRKMEGASKIFHDMMSYGLEPSNITYGILINGYCKNLRIDDGLILFKEMLRKGLKPTTLNYNIILDGLFLAGRTAAAKERFHEMVESGAHVCIDTYCIVLGGLCRNNCSSEAITLFGKLSAMNVRFDITIVNIIIGAFYRVERNQEAKDLFAAMPANCLVPNAVTYTIMMTNLIKEGSVEEADNLFLSMEKSGCTANSCLLNHVIRRLLEKGEIVKAGNYMYKVDAKNYSLEAKTVSLLMSLFTRKGKYREHIKLLPAKYQFLEEAATVE

SEQ ID NO: 305 - protein, 784 aa, Triticum aestivum
MPRFSSTTPLSPLRRRLRHSSSTSHSSRSWEPHAAFAAATERARSGNLTLEDAHHLFDELLRQGNPVQDRPLNKLLSALARAPASAACRNGPALAVALFSRISQGARRRVAEPTVCTYGILMDCCCRAHRLDLALAFFGHLLKTGLEVDQVVFNTLLKGLCHAKRADEALDVLLHRMTELGCTPNVVAYNTIIHGFFKEGQVSKACNLFHEMAQQGVPPNVVTYNSVIDALCKARAMDKAEVVLRQMIDRSVGPNSVTYSSLIHGYSSSGHWKEAVRVFKEMTSRRVTPNVHTYNMFITFLCKHGRSKEAAGIFDSMAMKGLKPDDVSYAILLHGYATEGSLVDMINLFNSMERDCILPDCRIFSILINAYAKSGKVDKVMLIFKKMQKQGVSPDAVTYSTLIDAFCKKGRLDDAMIKFNQMVDTGVRQGTAVYGSLIQGFCTHGDLVKGKELVTEMMNKGIPPPDIKFFHSIMQNLCTEGRVIEARDILGLIAHIGMRPNVCTFNILIGGYCLVRKMEGASKIFHDMMSYGLEPSNITYGILINGYCKNLRIDDGLILFKEMLRKGLKPTTLNYNIILDGLFLAGRTAAAKERFHEMVESGAHVCIDTYCIVLGGLCRNNCSSEAITLFGKLSAMNVRFDITIVNIIIGAFYRVERNQEAKDLFAAMPANCLVPNAVTYTIMMTNLIKEGSVEEADNLFLSMEKSGCTANSCLLNHVIRRLLEKGEIVKAGNYMYKVDAKNYSLEAKTVSLLMSLFTRKGKYREHIKLLPAKYQFLEEAATVE

SEQ ID NO: 306 - protein, 778 aa, Triticum aestivum
MPTGRLSSIFTSNATSSFRAPSPQPRAPLAALAAATERVCDGTLRPEEAHHLFDELLSQAAAVPERGLNNFLAALAHAPPSSTCSDGPGLAIALFNRMSRGAGARVVSPTLCTYSILMDCCCRAGRPDLVVAFFGRLLRLGLCLNVISFNNLLKGLCQVKRTNEAVDLLLHRTPELDCVPNVFSYSIVINGCFKQGEVDKACNLFHQMIQLGVQPNLVIYNSIIDALSKSGAMDKAEVVLRQMVDQGIEPNIRTYTSLIHGYSASGQWKAAARVFKEMVSVGVLPDAVAWNSFMDSLCKHRRTKDARVIFDSMAAKGQKPNIVSYSIMLNGYAKEGYFDDMTGLFNLMLQNGIVPNHHVFNILINAYSKRGLMDEAMHMFEVMRQQGVNPDVFGYQIVMDSLCKMGRVDAALDKFNQMVNQGVSPNKAVYQCLVLGSCSNGDFVKAKELISEAVNRGLCSNSVFFYPVINNLSKEGKVKDAQDMFDFIVGIGRPPDVIMYNSLMDGYCLVGKVEEALRVLDAMKSAGLQPDAFTYGILLNGYCKIGRIADGLSLFREMSLSGVKPTAIMYNIILDGLFRSGRAVSAKEKFCTMSESGIPVGIGTYNIVLHGLCRNNCTDEAIELFNKLRAMKLKINVITINTMISAMFKTRRIEEAKDLFATISAIGLVPSVVTYSVMMTNFIKEGLLAEADDMFLAMEKAGCAPDSRLLNHVVRVLLENGAVVKAATYLAKLDANHLSLEVSTISLIVSLFSGEGKLREHVELLPVKYQPPESSADN

SEQ ID NO: 307 - protein, 778 aa, Triticum aestivum; identical to SEQ ID NO: 306

SEQ ID NO: 308 - protein, 778 aa, Triticum aestivum; identical to SEQ ID NO: 306

SEQ ID NO: 309 - protein, 778 aa, Triticum aestivum; identical to SEQ ID NO: 306

SEQ ID NO: 310 - protein, 778 aa, Triticum aestivum; identical to SEQ ID NO: 306

SEQ ID NO: 311 - protein, 778 aa, Triticum aestivum; identical to SEQ ID NO: 306

SEQ ID NO: 312 - protein, 770 aa, Triticum aestivum
MPTARLSSISTSSFRAPSRAPLAALAAATERVRAGTLSREDAHHLFDELQGQAAAVPVRTLNNFLAALARAPPSSACSDGPGLAIALFNRMSRGAGARVVSPTLCTYSILMDCCCRAGRPDLVVAFFCRLLRLGLRFEEVISFNNLLKGLCQAKRSNEALDLLLHRMPELDCAPDVFSFNIVINGCLKEGEVDKACNLFHEMPQLGVQPDVVTYNSIIDALSKSGAMDKAEVLLRQMVDQGIEPNIRTYSCLIHGYSTFGQWKEALRVFKEMASLGVVPDVVTLSSLIDSLCKHRRTKQAREIFDSMAAKGLKPDIVSYSTMLNGYVKEGSFEDMTDLFNSMVRNGIVPNHHIFNILINAYAKRGLMDEAMHMFEVMRQQGVNPNVIDYLVIMDSLCKMGRMDAALEKFNQMVNQGVSPNKAVYQCLVLGSCSHGHFVKAKELISEAINRGLFSNSVFFYPVINDLCKEGKVKEAHDMFDFIVGIGQRPDVIMYNSLMDGYCLVGKVEEALRLLDAMKSAGLQPTGVTYAILLNGYCKIGRIADGLSLFREMSLSGVKPTTIMYNIILDGLFCSGRTVSAKEEFDTMSESGIPVNVRTYNIVLSGLCRNNCTGEAIELFKKLRAMNVKINVITLNTMISAMFKTRRIEEAKDLFATISAIGLVPSVVTYSVMMTNFIKEGLLAEADDMFLAMEKAGCAPNSSLLNQVVRVLLEKGAAVQAATYLAKLDAKQLSLEASTVSLILSLFSRKGKLREHVKLLPVKYQPPEMLD

SEQ ID NO: 313 - protein, 681 aa, Triticum aestivum
MSRGAGARVVSPTLCTYSILMDCCCRAGRPDLVVAFFGRLIRLGLRLEIISFSNLLKGLCQAKRSNEALDMLLHRMPELDCAPDVFSFNIVINGCFKEGEVDKACNLFHEMPQLGVQPDVVTYNSIIDALSKSRAMDKAEVVLRQMVDQGIEPNIRTYTSLIHGYSTSGQWKAAVRIFKEMASAGVRPNSVTLNSFIDSLCKHRKTKEARDIFDSMAAKGHKPDIFSYSTMLNGYAKEGCFDDMTDLFNSMVRNGIVPDHHVFNILINAYAKRGLMDKAMHMFEVMRQQGVNPNVVDYLVVMDSLCKMGKMAAAMDIFNQMVNQGVSPNIVVYRCMVLGSCSHGDFVKAKELISEAVNKGLCSNSVFFYPVINNLCKEGKVMEAQDMFDFDFIVGIGQRPDVIMYTSLMDGYCLVGKVEKALRVLDAMKSAGLQPTAVTYGALLNGYCKIGKIADGLSLFREMSLSGVKPTTIMYNIILDGLFCSGRPVSAKEEFDTMIESGIPVGVDTYNIVLSGLCKNNCTDEAMDLFKKLRATNMKIDVITLNIMISAMFKTRRIEEAKDLFATISAIGLVPCVVTYNLMMTNFIKEGLLPEADDMFLAMEKANCAPNSRLLNHVVRLLLEKGAVVKAATYLAKLDANHLSLEVSTISLIVSLFSGEGKLREHVELLPVKYQPPEMSI

SEQ ID NO: 314 - protein, 778 aa, Triticum aestivum
  misc_feature (433)..(433): Xaa can be any naturally occurring amino acid
MPTGRLSSIFTSNATSSFRAPSPQPRPPLAALAAATERVRAGTLSREEAHHLFDELQGQAAAVPERGLNNFLAALARAPPSSACGDGPALAVALFNRMSRGAGARVVSPTLCTYSILMDCCCRAGRPDLVVAFFGRLIRLGLRLEIISFSNLLKGLCQAKRSNEALDMLLHRMPELDCAPDVFSFNIVINGCFKEGEVDKACNLFHEMPQLGVQPDVVTYNSIIDALSKSRAMDKAEVVLRQMVDQGIEPNIRTYTSLIHGYSTSGQWKAAVRIFKEMASAGVRPNSVTLNSFIDSLCKHRKTKEARDIFDSMAAKGHKPDIFSYSTMLNGYAKEGCFDDMTDLFNSMVRNGIVPDHHVFNILINAYAKRGLMDKAMHMFEVMRQQGVNPNVVDYLVVMDSLCKMGKMAAAMDIFNQMVNQGVSPNIVVYRCXVLGSCSHGDFVKAKELISEAVNKGLCSNSVFFYPVINNLCKEGKVMEAQDMFDFDFIVGIGQRPDVIMYTSLMDGYCLVGKVEKALRVLDAMKSAGLQPTAVTYGALLNGYCKIGKIADGLSLFREMSLSGVKPTTIMYNIILDGLFCSGRPVSAKEEFDTMIESGIPVGVDTYNIVLSGLCKNNCTDEAMDLFKKLRATNMKIDVITLNIMISAMFKTRRIEEAKDLFATISAIGLVPCVVTYNLMMTNFIKEGLLPEADDMFLAMEKANCAPNSRLLNHVVRLLLEKGAVVKAATYLAKLDANHLSLEVSTISLIVSLFSGEGKLREHVELLPVKYQPPEMSI

SEQ ID NO: 315 - protein, 222 aa, Triticum aestivum
MLHKGLKPTTFNYNVILDGLFLARQTVASKVKFHEMAESGVSVCIDTYSIVLGGLCRNNCIGEAITLFQKLSTMNVKFNIAIVNIMIGAFFRVRRNQEAKDLFAAVSANGLVANVFTYTVMMINLIEEGSLEEADTLFLSMKKSGCTANSCMLNHIIRRLLERGEIVKAGNYMSKVDAKSYSLEAKTVLLLISLFSGNGKYREHIKLLPMKYQFLEEAATVE

SEQ ID NO: 316 - protein, 328 aa, Triticum aestivum
MMKKGMLPPDIMFFSSIMQNLCTEGRVIEARDILDLIVCIGMRPDVFIFNILIGGYCLVRKMADASKIFDDMVSYGLEPCNITYGILINGYCKNGRIDDGLILFKEMLHKGLKPTTFNYNVILDGLFLARQTVASKVKFHEMAESGVSVCIDTYSIVLGGLCRNNCIGEAITLFQKLSTMNVKFNIAIVNIMIGAFFRVRRNQEAKDLFAAVSANGLVANVFTYTVMMINLIEEGSLEEADTLFLSMKKSGCTANSCMLNHIIRRLLERGEIVKAGNYMSKVDAKSYSLEAKTVLLLISLFSGNGKYREHIKLLPMKYQFLEEAATVE

SEQ ID NO: 317 - protein, 487 aa, Triticum aestivum
  misc_feature (16)..(16): Xaa can be any naturally occurring amino acid
  misc_feature (18)..(25): Xaa can be any naturally occurring amino acid
  misc_feature (27)..(28): Xaa can be any naturally occurring amino acid
MRIVLKSAEKDFVLSXLXXXXXXXXCXXHTKAMPRFSSSTPMSPPRLRLLLLLRLGARHSSSTSHPSRIWDPHAAFAAATQRARSGTLTTEDAHHLFEELLRQGNPVQERPLTNFLAALARAPASPFCSDGPALAVALFSRLSRGAGRRVAQPNVFTYGVLMDCCCRARRLDVAIAFFAHLLKTGLEAGQVVFGTLLKGLCHAKHSDEALDVVLHRMPELGCTPDVVAYTTVIHGFLKEGQVGKACNLFHGMAQQGVAPDVVTYSSVIDALCKARAMDKAEYFLREMVDNGVVPNNVTYNSLIHGYSSLGHQKEAVRVLKEMTRQGIIPDVFTCNSVMASLCKNGKSKEAAKMFDSMSMKGLKPNTVSYVILLHGYATEGCLVDMINLFNSMATDCILPNCHIFNILIYAYAKSGKLDKAMLIFKEMQKQGVSPDAVTYSTVIHAFCKKGRLDDAVIKFNQMIDTGVRPDASVYRSLIQGESKGICY

SEQ ID NO: 318 - protein, 328 aa, Triticum aestivum; identical to SEQ ID NO: 316

SEQ ID NO: 319 - protein, 792 aa, Triticum aestivum
MPRFSSSTPMSPPRLRLLLLLRLGARHSSSTSHPSRIWDPHAAFAAATQRARSGTLTTEDAHHLFEELLRQGNPVQERPLTNFLAALARAPASPFCSDGPALAVALFSRLSRGAGRRVAQPNVFTYGVLMDCCCRARRLDLAIAFFAHLLKTGLEAGQVVFGTLLKGLCHAKHSDEALDVVLHRMPELGCTPDVVAYTTVIHGFLKEGQVGKACNLFHGMAQQGVAPDVVTYSSVIDALCKARAIDKAEYFLREMVDNGVVPNNVTYNSLIHGYSSLGHQKEAVRVLKEMTRQGIIPDVFTCNSVMASLCKNGKSKEAAKMFDSMSMKGLKPNTVSYVILLHGYATEGCLVDMINLFNSMATDCILPNCHIFNILIYAYAKSGKLDKAMLIFKEMQKQGVSPDAVTYSTVIHAFCKKGRLDDAVIKFNQMIDTGVRPDASVYRSLIQGFCTHGDLVKAKEYVTEMMKKGMLPPDIMFFSSIMQNLCTEGRVIEARDILDLIVCIGMRPDVFIFNILIGGYCLVRKMADASKIFDDMVSYGLEPCNITYGILINGYCKNGRIDDGLILFKEMLHKGLKPTTFNYNVILDGLFLARQTVAAKVKFHEMAESGVSVCIDTYSIVLGGLCRNNCIGEAITLFQKLSTMNVKFNIAIVNIMIGAFFRVRRNQEAKDLFAAVSANGLVANVFTYTVMMINLIEEGSLEEADTLFLSMKKSGCTANSCMLNHIIRRLLERGEIVKAGNYMSKVDAKSYSLEAKTVLLLISLFSGNGKYREHIKLLPMKYQFLEEAATVE

SEQ ID NO: 320 - protein, 455 aa, Triticum aestivum
  misc_feature (11)..(11): Xaa can be any naturally occurring amino acid
MPRFSSSTPMXPPRLRLLLLLRLGARHSSSTSHPSRIWDPHAAFAAATQRARSGTLTTEDAHHLFEELLRQGNPVQERPLTNFLAALARAPASPFCSDGPALAVALFSRLSRGAGRRVAQPNVFTYGVLMDCCCRARRLDLAIAFFAHLLKTGLEAGQVVFGTLLKGLCHAKHSDEALDVVLHRMPELGCTPDVVAYTTVIHGFLKEGQVGKACNLFHGMAQQGVAPDVVTYSSVIDALCKARAIDKAEYFLREMVDNGVVPNNVTYNSLIHGYSSLGHQKEAVRVLKEMTRQGIIPDVFTCNSVMASLCKNGKSKEAAKMFDSMSMKGLKPNTVSYVILLHGYATEGCLVDMINLFNSMATDCILPNCHIFNILIYAYAKSGKLDKAMLIFKEMQKQGVSPDAVTYSTVIHAFCKKGRLDDAVIKFNQMIDTGVRPDASVYRSLIQGESKGICY

SEQ ID NO: 321 - protein, 792 aa, Triticum aestivum
MPRFSSSTPMSPPRLRLLLLLRLGARHSSSTSHPSRIWDPHAAFAAATQRARSGTLTTEDAHHLFEELLRQGNPVQERPLTNFLAALARAPASPFCSDGPALAVALFSRLSRGAGRRVAQPNVFTYGVLMDCCCRARRLDVAIAFFAHLLKTGLEAGQVVFGTLLKGLCHAKHSDEALDVVLHRMPELGCTPDVVAYTTVIHGFLKEGQVGKACNLFHGMAQQGVAPDVVTYSSVIDALCKARAMDKAEYFLREMVDNGVVPNNVTYNSLIHGYSSLGHQKEAVRVLKEMTRQGIIPDVFTCNSVMASLCKNGKSKEAAKMFDSMSMKGLKPNTVSYVILLHGYATEGCLVDMINLFNSMATDCILPNCHIFNILIYAYAKSGKLDKAMLIFKEMQKQGVSPDAVTYSTVIHAFCKKGRLDDAVIKFNQMIDTGVRPDASVYRSLIQGFCTHGDLVKAKEYVTEMMKKGMLPPDIMFFSSIMQNLCTEGRVIEARDILDLIVCIGMRPDVFIFNILIGGYCLVRKMADASKIFDDMVSYGLEPCNITYGILINGYCKNGRIDDGLILFKEMLHKGLKPTTFNYNVILDGLFLARQTVAAKVKFHEMAESGVSVCIDTYSIVLGGLCRNNCIGEAITLFQKLSTMNVKFNIAIVNIMIGAFFRVRRNQEAKDLFAAVSANGLVANVFTYTVMMINLIEEGSLEEADTLFLSMKKSGCTANSCMLNHIIRRLLERGEIVKAGNYMSKVDAKSYSLEAKTVLLLISLFSGNGKYREHIKLLPMKYQFLEEAATVE

SEQ ID NO: 322 - protein, 181 aa, Triticum aestivum
MPTGRLSSIFTSNATSSFRAPSPQPRAPLAALAATTERVCAGTLRPEEAHHLFDELLSQAAAVPERGLNNFLAALARAPPSAACSDGPGLAITLFNRMSRGAGAQVVSPTLCTYSILMDCCCRAGRPDLVVAFFGRLLRSSPSTTSSRGSARSSVQMRLWTCCSTGHLNWTVCLMSSRTAS

SEQ ID NO: 323 - protein, 365 aa, Triticum aestivum
MPTGRLSSIFTSNATSSFRAPSPQPRAPLAALAATTERVCAGTLRPEEAHHLFDELLSQAAAVPERGLNNFLAALARAPPSAACSDGPGLAITLFNRMSRGAGAQVVSPTLCTYSILMDCCCRAGRPDLVVAFFGRLLRLGLHLNVISFNNLLKGLCQVKRTNEAVDLLLHRTPELDCVPNVFSYSIVINGCFKEGEVDKACNLFHEMPQLGVQPNVVIYTSIIDALSKCGAMDKAEVVLQQMVDQGIEPNIRTYTSLIHGYSASGQWKAAARVFKEMVSAGVLPNAVTLNSFMDSLCKHRRTKEKGNLVHVAPTCAGSREGSDHFGSIVRSLSLHFCKRLFPGLEPMTSWSQGSSFTTAPRLPS

SEQ ID NO: 324 - protein, 272 aa, Triticum aestivum
MDIELVGKVEEALRVLDAMKSAGLQPTAVTYAILLNGYCKIGRIADGLSLFREMSLSGVKPTTFMYNIILDGLFRSGRAVSAKEKFRTMSESGIPVGIVTYNIVLHGFCRNNCTDEAIELFKKLRGMNVKIDVITLTTMISAMFKTRRIEEAKDLFATISAIGLVPSVVTYSVMMTNFIKEGLLAEADDMFLAMEKAGCAPDSRLLNHVVRVLLENGAVVKAATYLAKLDAKQLSLEASTVSLILSLFSRKGKLREHVKLLPVKYQPPEMLD

SEQ ID NO: 325 - protein, 181 aa, Triticum aestivum; identical to SEQ ID NO: 322

SEQ ID NO: 326 - protein, 507 aa, Triticum aestivum
MPTGRLSSIFTSNATSSFRAPSPQPRAPLAALAATTERVCAGTLRPEEAHHLFDELLSQAAAVPERGLNNFLAALARAPPSAACSDGPGLAITLFNRMSRGAGAQVVSPTLCTYSILMDCCCRAGRPDLVVAFFGRLLRLGLRLNVISFNNLLKGLCQVKRTNEAVDLLLHRTPELDCVPNVFSYSIVINGCFKEGEVDKACNLFHEMPQLGVQPNVVIYTSIIDALSKCGAMDKAEVVLQQMVDQGIEPNIRTYTSLIHGYSASGQWKAAARVFKEMVSVGVLPNAVTLNSFMDSLCKHRRTKDARDIFDSMAAKGQKPDIFSYSIMLNGYAKEGYFEDMTDLFNLMVLNGIVPNHHIFNILINAYAKRGLMDEAMHMFEVMRQQGVNPNVVDYVVVMDSLCKMGRMDAALDKFTQLVNQGVSPNKAVYQCLVLGSCSHGHFVKAKELISEAINRGLFSNSVFFYPVINDLCKEGKVKEAQDMFDFILGIGRRPDVIMYNSLMDGY

SEQ ID NO: 327 - protein, 776 aa, Triticum aestivum
MPTGRLSSIFTSNATSSFRAPSPQPRAPLAALAATTERVCAGTLRPEEAHHLFDELLSQAAAVPERGLNNFLAALARAPPSAACSDGPGLAITLFNRMSRGAGAQVVSPTLCTYSILMDCCCRAGRPDLVVAFFGRLLRLGLRLNVISFNNLLKGLCQVKRTNEAVDLLLHRTPELDCVPNVFSYSIVINGCFKEGEVDKACNLFHEMPQLGVQPNVVIYTSIIDALSKCVAMDKAEVVLQQMVDQGIEPNIRTYTSLIHGYSASGQWKAAARVFKEMVSVGVLPNAVTLNSFMDSLCKHRRTKDARDIFDSMAAKGQKPDIFSYSIMLNGYAKEGYFEDMTDLFNLMVLNGIVPNHHIFNILINAYAKRGLMDEAMHMFEVMRQQGVNPNVVDYVVVMDSLCKMGRMDAALDKFTQMVNQGVSPNKAVYQCLVLGSCSHGHFVKAKELISEAINRGLFSNSVFFYPVINDLCKEGKVKEAQDMFDFILGIGRRPDMIMYNSLMDGYCLVGKVEEALRVLDAMKSAGLQPTAVTYAILLNGYCKIGRIADGLSLFREMSLSGVKPTTFMYNIILDGLFRSGRAVSAKEKFRTMSESGIPVGIVTYNIVLHGFCRNNCTDEAIELFKKLRGMNVKIDVITLTTMISAMFKTRRIEEAKDLFATISAIGLVPSVVTYSVMMTNFIKEGLLAEADDMFLAMEKAGCAPDSRLLNHVVRVLLENGAVVKAATYLAKLDAKQLSLEASTVSLILSLFSRKGKLREHVKLLPVKYQPPEMLD

SEQ ID NO: 328 - protein, 507 aa, Triticum aestivum
MPTGRLSSIFTSNATSSFRAPSPQPRAPLAALAATTERVCAGTLRPEEAHHLFDELLSQAAAVPERGLNNFLAALARAPPSAACSDGPGLAITLFNRMSRGAGAQVVSPTLCTYSILMDCCCRAGRPDLVVAFFGRLLRLGLRLNVISFNNLLKGLCQVKRTNEAVDLLLHRTPELDCVPNVFSYSIVINGCFKEGEVDKACNLFHEMPQLGVQPNVVIYTSIIDALSKCGAMDKAEVVLQQMVDQGIEPNIRTYTSLIHGYSASGQWKAAARVFKEMVSVGVLPNAVTLNSFMDSLCKHRRTKDARDIFDSMAAKGQKPDIFSYSIMLNGYAKEGYFEDMTDLFNLMVLNGIVPNHHIFNILINAYAKRGLMDEAMHMFEVMRQQGVNPNVVDYVVVMDSLCKMGRMDAALDKFTQMVNQGVSPNKAVYQCLVLGSCSHGHFVKAKELISEAINRGLFSNSVFFYPVINDLCKEGKVKEAQDMFDFILGIGRRPDVIMYNSLMDGY

SEQ ID NO: 329 - protein, 272 aa, Triticum aestivum
MDIELVGKVEEALRVLDAMKSAGLQPTAVTYAILLNGYCKIGRIADGLSLFREMSLSGVKPTTFMYNIILDGLFRSGRAVSAKEKFRTMSESGIPVGIVTYNIVLHGFCRNNCTDEAIELFKKLRGMNVKIDVITLTTMISAMFKTRRIEEAKDLFATISAIGLVPSVVTYSVMMTNFIKEGLLAEADDMFLAMEKAGCAPDSRLLNHVVRVLLENGAVVKAATYLAKLDAKQLSLEASTVSLILSLFSRKGKLREHVKLLPVKYQPPKMLD

SEQ ID NO: 330 - protein, 507 aa, Triticum aestivum; identical to SEQ ID NO: 326

SEQ ID NO: 331 - protein, 272 aa, Triticum aestivum
MDIELVGKVEEALRVLDAMKSAGLQPTAVTYAILLNGYCKIGRIADGLSLFREMSLSGVKPTTFMYNIILDGLFRSGRAVSAKEKFRTMSESGIPVGIVTYNIVLHGFCRNNCTDEAIELFKKLRGMNVKIDVITLTTMISAMFKTRRIEEAKDLFATISAIGLLPSVVTYSVMMTNFIKEGLLAEADDMFLAMEKAGCAPDSRLLNHVVRVLLENGAVVKAATYLAKLDAKQLSLEASTVSLILSLFSRKGKLREHVKLLPVKYQPPEMLD

SEQ ID NO: 332 - protein, 272 aa, Triticum aestivum; identical to SEQ ID NO: 324

SEQ ID NO: 333 - protein, 771 aa, Triticum aestivum
MPAARLSSISTSSFRAPSRAPLAALAAATERVRAGTLSQEDAHHLFDELLGQAAAVPERGLNNFLAALARAPPSAACRDGPGLAIALFNHMSRGAGARVVSPTLCTYSILMDCCCRAGRPDLVVAFFGRLIRLGLRLEVISFSNLLKGLCQAKRTNEAVDLLLHRTPELDCVPNVFSYNIVISSCFKEGEVDKACNLFHEMPQLGVQPNVVIYTSIIDALSKCGAMDKAEVVLQQMVDQGIEPDIRTYTSLIHGYSASGQWKAAVRVFKEMVSVGVLPNAVTLNSFMDSLCKHRRTKEAREIFDSMAAKGLKPNIVSYSTMLNGYVKEGSFEDMTDLFNSMVRNGIVPNHHIFNILINAYAKRGLMDEAMHMFEVMRQQGVNPDVFDYQIIMDSLCKMGRMDAALDKFNQMVNQGVSPNKAVYQCLVLGSCSHGDFVKAKELISEAVNRGLCSNSVFFYPVINDLCKEGKVKEAQDMFDFILGIGQRPDVIMYTSLMDGYCLVGKVEKALSVLDAMKSAGLQPDDVVYATLLNGYCKIGRIADGLSLFREMSLSGVKPTTIIYNIILDGLFCSGRTGSAKEKFHTMTESGIPVGVDTYNIVLSGLCRNNCTDEAIELFKKLRATNVKIDIMTLNIMISAMFKTRRIEEAKDLFATISAIGLVPSVVTYSLMMTNFIKEGLLADADDTFLVMEKAGCAPNSSLLNQVVRVLLEKGAFVKAATYLAKLDAKQLSVEASTISLIVSLFSGEGKPREHVELLPVKYQPPQSSADN

SEQ ID NO: 334 - protein, 771 aa, Triticum aestivum
MPAARLSSIPTSSFRASSRAPLAALAVATERVRAGTLSREDAHHLFDELLGQAAAVPERGLNNFLAALARAPPSAACRDGPGLAIALFNRMSRGTGARVVSPTLCTYSILMDCCCRAGRPDLVVAFFGRLLRLGLRLDVISLSNLLKGLCQAKRSNEALDLLLHRMPELHCAPGVFSYNIVINGCLKEGEVDKACNLFHEMPQLGVQPDVVTYTSIMDALSKSGAMDKAEVLLRQMVDQGIEPNIRTYSCLIHGYSTFGQWKEALRVFKEMATLGVVPDVVTLSSLIDSLCKHRRTKEAREIFDSMAAKGLKPNIVSYSTMLNGYVKEGSFEDMTDLFNSMVRNGIVPDHHIFNIQINAYAKRGLMDEAMHMFEVMRQQGVNPDVFDYQIIMDSLCKMGRMDAALDKFNQMVNQGVSPNKAVYQCLVLGSCSHGDFVKAKELISEAVNRGLCSNSVFFYPVINDLCKEGKVKEAQDMFDFILGIGQRPDVIMYTSLMDGYCLVGKVEKALSVLDAMKFAGLQPDDVVYGTLLNSYCKIGRIADGLSLFREMSLSGVKPTTIIYNIILDGLFCSGRTGSAKEKFHTMTESGIPVGVDTYNIVLSGLCRNNCTDEAIELFKKLRATNVKIDVMTLNIMISAMFKTRRIEEAKDLFATISAIGLVPSVVTYSLMMTNFIKEGLLADADDTFLVMEKAGCAPNSSLLNQVVRVLLEKGAVLKAATYLAKLDAKQLSVEVSTISLIVSLFSGEGKLREHVELLPVKYQPPQSSADN

SEQ ID NO: 335 - protein, 681 aa, Triticum aestivum
MSRGAGARVVSPTLCTYSILMDCCCRAGRPDLVLAFFGRLLRLGLRLDVISLSNLLKGLCQAKRSNEALDLLLHRMPELHCAPDVFSYNIVINGCLKEGEVDKACNLFHEMPQLGVQPDVVTYTSIMDALSKSGAMDKAEVLLRQMVDQGIEPNIRTYSCLIHGYSTFGQWKEALRVFKEMASLGVVPDVVTLSSLIDSLCRHRRTKQAREIFDSMAAKGLKPNIVSYSTMLKGYVKEGSFEDMTDLFNSMVRNGIVPDHHIFNIQINAYAKRGLMDEAMHMFEVMRQQGVNPDVFDYQIIMDSLCKMGRMDAALDKFNQMVNQGVSPNKAVYQCLVLGSCSHGDFVKAKELISEAVNRGLCSNSVFFYPVINDLCKEGKVKEAQDMFDFILGIGQRPDVIMYTSLMDGYCLVGKVEKALSVLDAMKFAGLQPDDVVYGTLLNGYCKIGRIADGLSLFREMSLSGVKPTTIIYNIILDGLFCSGRTGSAKEKFHTMTESGIPVGVDTYNIVLSGLCRNNCTDEAIELFKKLCATNVKIDVMTLNIMISAMFKTRRIEEAKDLFATISAIGLVPSVVTYSLMMTNFIKEGLLADADDTFLVMEKAGCAPNSSLLNQVVRVLLEKGAVLKAATYLAKLDAKQLSVEVSTISLIVSLFSGEGKLREHVELLPVKYQPPQSSADN

SEQ ID NO: 336 - protein, 681 aa, Triticum aestivum; identical to SEQ ID NO: 335

SEQ ID NO: 337 - protein, 771 aa, Triticum aestivum; identical to SEQ ID NO: 334

SEQ ID NO: 338 - protein, 519 aa, Triticum aestivum
  misc_feature (350)..(350): Xaa can be any naturally occurring amino acid
  misc_feature (509)..(509): Xaa can be any naturally occurring amino acid
  misc_feature (517)..(517): Xaa can be any naturally occurring amino acid
MPQLGVQPDVVTYTSIMDALSKSGAMDKAEVLLRQMVDQGIEPNIRTYSCLIHGYSTFGQWKEALRVFKEMASLGVVPDVVTLSSLIDSLCRHRRTKQAREIFDSMAAKGLKPNIVSYSTMLKGYVKEGSFEDMTDLFNSMVRNGIVPDHHIFNIQINAYAKRGLMDEAMHMFEVMRQQGVNPDVFGYQIIMDSLCKMGKMDAALDKFNQMVNQGVSPNKAVYQCLVLGSCSHGDFVKAKELISEAVNRGMCSNSVFFYPVINDLCKEGKVKEAQDMFDFILGIGQRPDVIMYTSLMDGYCLVGKVEKALSVLDAMKFAGLQPDDVVYGTLLNSYCKIGRIADGLSLFRXMSLSGVKPTTIIYNIILDGLFCSGRTGSAKEKFHTMTESGIPVGVDTYNIVLSGLCRNNCTDEAIELFKKLRATNVKIDVMTLNIMISAMFKTRRIEEAKDLFATISAIGLVPSVVTYSLMMTNFIKEGLLADADDTFLVMEKAGCAPNSSLLNQVVRXLLEKGAVXNE

SEQ ID NO: 339 - protein, 681 aa, Triticum aestivum; identical to SEQ ID NO: 335

SEQ ID NO: 340 - protein, 771 aa, Triticum aestivum
MPAARLSSIPTSSFRASSRAPLAALAVATERVRAGTLSREDAHHLFDELLGQAAAVPERGLNNFLAALARAPPSAACRDGPGLAIALFNRMSRGTGARVVSPTLCTYSILMDCCCRAGRPDLVLAFFGRLLRLGLRLDVISLSNLLKGLCQAKRSNEALDLLLHRMPELHCAPGVFSYNIVINGCLKEGEVDKACNLFHEMPQLGVQPDVVTYTSIMDALSKSGAMDKAEVLLRQMVDQGIEPNIRTYSCLIHGYSTFGQWKEALRVFKEMATLGVVPDVVTLSSLIDSLCKHRRTKEAREIFDSMAAKGLKPNIVSYSTMLNGYVKEGSFEDMTDLFNSMVRNGIVPDHHIFNIQINAYAKRGLMDEAMHMFEVMRQQGVNPDVFDYQIIMDSLCKMGRMDAALDKFNQMVNQGVSPNKAVYQCLVLGSCSHGDFVKAKELISEAVNRGLCSNSVFFYPVINDLCKEGKVKEAQDMFDFILGIGQRPDVIMYTSLMDGYCLVGKVEKALSVLDAMKFAGLQPDDVVYGTLLNSYCKIGRIADGLSLFREMSLSGVKPTTIIYNIILDGLFCSGRTGSAKEKFHTMTESGIPVGVDTYNIVLSGLCRNNCTDEAIELFKKLRATNVKIDVMTLNIMISAMFKTRRIEEAKDLFATISAIGLVPSVVTYSLMMTNFIKEGLLADADDTFLVMEKAGCAPNSSLLNQVVRVLLEKGAVLKAATYLAKLDAKQLSVEVSTISLIVSLFSGEGKLREHVELLPVKYQPPQSSADN

SEQ ID NO: 341 - protein, 787 aa, Triticum aestivum
MPRFSSSTPMSPPRLRLRLCARHSSSTSHPSRIWDPHAAFAAATQRAHSGNLTPEDAHHLFDELLRQGNPVQERPLNNFLATLARAPASASCSDGPALAVALFGRLSGGAGRRVAQPNVFTYGVLMDCCCRACRTDLALAFFGRLFRTGLEANQVIFCTLLKGLCHAKRTDEALDVLLHRMPELGCTPYVVAYNTVIHGFFREGQVGKACDLFHGMAQQGVMPDVVTYNSVIDALCKARAMDKAEYFLRQMVDNGVVPNTVTYNSLIHGYSSSGHWKEAVRVFKEMASQRVTADVHTYNMFMTFLCKHGRSKEAAGIFDTMAIKGLKPDNVSYAIRLHGYATEGCLVDMINLFNSMERDCILPDCRIFNILINAYAKSGKLDKAMLIFNEMQKQGVSPNAVTYSTVIDAFCKKGQLDDAMIKFNQMIDTGVPQGTAVYGSLIQGFCTHGNLVKAKELLTEMMNKGIPPPDIKFFHSIMQNLCTEGRVIEAHDVLGLIAHIGMRPNVCTFNILSGGYCLVGKMEDASKIFDDMMSYGLEPSNMTYGILINGYCKNERINDGLILFKEMLRKGLKPTTFNYNVILDGLFLTGRTVAAKEKFDEMVESGVSVCIDTYSIVLGGLCRNNCSGEAIMLFQKLSTMDVKFNITIVNIMIDAFYRVQRNQEAKDLFAAVSANGLVADVFTYTIMMKNLIKEGSVEEADDLFLSMEKSGCTADSYMLNLIVRMLLEKGELVKAGNYMSKVDAMSYSLEAETVSLLISLFSGKGKYREHIGLLPTKYRFHEEAATV

SEQ ID NO: 342 - protein, 787 aa, Triticum aestivum
MPRFSSSTPMSPPRLRLRLCARHSSSTSHPSRIWDPHAAFAAATQRARSGNLTPEDAHHLFDELLRQGNRVQERPLNNFLATLARAPASASCSDGPALAVALFGRLSGGAGRRVAQPNVFTYGVLMDCCCCACRTDLALAFFGRLLKTGLEADQVVFCTLLKGLCHAKRADEALDVLLHRMPELGCTPYVVAYNTVIHGFFREGQVGKACNLFHEMRQQGVTPDVVTYNTVIDALCKAKAMDKAEYFLGQMVDDGVVPDNVTYNSLIHGYSSSGHSKEAVRVLKEMTSKGIIPDVFTCNSLMASLCKNGRSKEAAEIFDSMSMKGLKPNTVSYAILLHGYAIEGCLVDMINLFNSMATDCILPNCHIFSILINAYAKSGKLDKAMLIFHEMQKQGVSPNAVTYSTVIDAFCKKGQLDDAMIKFNQMIDTGVRQGTAVYGSLIQGFCTHGDLVKAKELLTEMMNKGIPPPDIKFFHSIMQNLGTEGRVIEARDVLGLIAHIGMRPNVCTFNILIGGYCLVGKMEDASKIFDDMMSYGLEPSNITYGILINGYCKNERINDGLILFKEMLRKGLKPTTFNYNVILDGLFLTGRTVAAKEKFDEMVESGVSVCIDTYSIVLGGLCKNNCSGEAITLFQKLSTMDVKFNITIVNIMIDAFYRVQRNQEAKDLFAAVSANGLVANVFTYTIMMKNLIKEGSVEEADDLFLSMEKSGCTADSYMLNLIVRMLLEKGELVKAGNYMSKVDAMSYSLEAETVSLLISLFSGKGKYREHIGLLPTKYRFHEEAATV

SEQ ID NO: 343 - protein, 779 aa, Triticum aestivum
MSPPRLRLRLCARHSSSTSHPSRIWDPHAAFAAATERAHSGNLTPEDAHHLFDELLRQANPVQERPLNNLLAALARAPASAACSDGPALTVNLFSRISQGARRRVAHPTACTYGILMDCCCRAHRLDLAFAFFGCLLRTGLKAGVIQVCTLLKGLCRAKRADEALDMLLHRMPELGCTPNVVAYTTVIHGFFKEGQVGKACNLFHGMAQQGVMPDVVTYNSVIDALCKARAMDKAEYFLRQMVDNGVVPNNVTYNSLIHGYSSSGHWKEAVRVFKEMTSRRVTADVHTYNMFMTFLCKHGRSKEAAGIFDTMAMKGLKPDNVSYAIRLHGYATEGCLVDMINLFNSMERDCILPDCYIFNILINAYAKSGKLDKAMLIFNEMQKQGVSPNAVTYSTVIDAFCKKGQLDDAMIKFNQMIDTGVRQGTAVYRSLIQGFCTHSDLVKAKELLTEMMNKGIPPPDIKFFHSIMQNLCTEGRVIEARDILGLIAHIGMRPNVCTFNILIGGYCLVGKMEDASKIFDDMMSYGLEPCNITYGILINGYCKNRRIDDGLILFKEMLHKGLKPTTFNYNVILDGLFLVGRTVAAKEKFDEMVESGVCVCIDTYSIVLGGLCRNNCSGEAITLFQKLSTMEVKFNITIVNIMIDAFYKVQRNQEAKDLFAAVSANGLVADVFTYTRMMKNLIKEGSVEEADDLFLSMEKSGCTADSYMLNLIVRMFLGKGEIVKAGNYISKIDAKSYSLEAKTVSLLISLFSGKGKYREHIGLLPAKYRFREEAATVV

SEQ ID NO: 344 - protein, 779 aa, Triticum aestivum
MSPPRLRLRLCARHSSSTSHPSRIWDPHAAFAAATERAHSGNLTPEDAHHLFDELLRQANPVQERPLNNLLAALARAPASAACSDGPALTVNLFSRISQGARRRVAHPTACTYGILMDCCCRAHRLDLAFAFFGCLLRTGLKAGVIQVCTLLKGLCRAKRADEALDMLLHRMPELGCTPNVVAYTTVIHGFFKEGQVGKACNLFHGMAQQGVMPDVVTYNSVIDALCKARAMDKAEYFLRQMVDNGVVPNNVTYNSLIHGYSSSGHWKEAVRVFKEMTSRRVTADVHTYNMFMTFLCKHGRSKEAAGIFDTMAMKGLKPDSVSYAIRLHGYATEGCLVDMINLFNSMERDCILPDCRIFNILINAYAKSGKLDKAMLIFNEMQKQGVSPNAVTYSTVIDAFCKKGQLDDAMIKFNQMIDTGVRQGTAVYRSLIQGFCTHSDLVKAKELLTEMMNKGIPPPDIKFFHSIMQNLCTEGRVIEARDILGLIAHIGMRPNVCTFNILIGGYCLVGKMEDASKIFDDMMSYGLEPCNITYGILINGYCKNRRIDDGLILFKEMLHKGLKPTTFNYNVILDGLFLAGRTVAAKEKFDEMVESGVSVCIDTYSIVLGGLCRNNCSGEAITLFQKLSTMEVKFNITIVNIMIDAFYKVQRNQEAKDLFAAVSANGLVADVFTYTRMMKNLIKEGSVEEADDLFLSMEKSGCTADSYMLNLIVRMFLGKGEIVKAGNYISKIDAKSYSLEAKTVSLLISLFSGKGKYREHIGLLPAKYRFREEAATVV

SEQ ID NO: 345 - protein, 779 aa, Triticum aestivum
MSPPRLRLRLCARHSSSTSHPSRIWDPHAAFAAATERARSGNLTPEDAHHLFDELLRQANPVQERPLNNLLAALARAPASAACSDGPALTVNLFSRISQGARRRVAHPTACTYGILMDCCCRAHRLDLAFAFFGCLLRTGLKAGVIQVCTLLKGLCRAKRADEALDMLLHRMPELGCTPNVVAYTTVIHGFFKEGQVGKACNLFHGMAQQGVMPDVVTYNSVIDALCKARAMDKAEYFLRQMVDNGVVPNNVTYNSLIHGYSSSGHWKEAVRVFKEMTSRRVTADVHTYNMFMTFLCKHGRSKEAAGIFDTMAMKGLKPDSVSYAIRLHGYATKGCLVDMINLFNSMERDCILPDCRIFNILINAYAKSGKLDKAMLIFNEMQKQGVSPNAVTYSTVIDAFCKKGQLDDAMIKFNQMIDTGVRQGTAVYRSLIQGFCTHSDLVKAKELLTEMMNKGIPPPDIKFFHSIMQNLCTEGRVIEARDILGLIAHIGMRPNVCTFNILIGGYCLVGKMEDASKIFDDMMSYGLEPCNITYGILINGYCKNRRIDDGLILFKEMLHKGLKPTTFNYNVILDGLFLAGRTVAAKEKFDEMVESGVSVCIDTYSIVLGGLCRNNCSGEAITLFQKLSTMEVKFNITIVNIMIDAFYKVQRNQEAKDLFAAVSANGLVADVFTYTRMMKNLIKEGSVEEADDLFLSMEKSGCTADSYMLNLIVRMFLGKGEIVKAGNYISKIDAKSYSLEAKTVSLLISLFSGKGKYREHIGLLPAKYRFREEAATVV

SEQ ID NO: 346 - protein, 230 aa, Triticum aestivum
  misc_feature (171)..(171): Xaa can be any naturally occurring amino acid
  misc_feature (197)..(197): Xaa can be any naturally occurring amino acid
  misc_feature (201)..(201): Xaa can be any naturally occurring amino acid
  misc_feature (204)..(204): Xaa can be any naturally occurring amino acid
MDKFNEMTDMGFQPDTTVYHSLIQGFCMHGDLVKAKGLVSEMMNKGIPRPDIAFFNSIINTLCKEGGVMDAQDVFDLVTAIDERPNIITFNSLIDGYCLVGEMDKAFGVLDAMKSVGAEPDIVTYNTLVNGYCRNGRIDDGLTLFREMPHKRIKPDTVTYGIILDGLFHAXRTVVARKMFHEMIESETTVDIPVYNXILKXLFXCITYNLSSLKSSRKQCFDILSARFHK

SEQ ID NO: 347 - protein, 321 aa, Triticum aestivum
MDKFNEMTDMGFQPDTTVYHSLIQGFCMHGDLVKAKGLVSEMMNKGIPRPDIAFFNSIINTLCKEGGVMDAQDVFDLVTAIDERPNIITFNSLIDGYCLVGEMDKAFGVLDAMKSVGAEPDIVTYNTLVNGYCRNGRIDDGLTLFREMPHKRIKPDTVTYGIILDGLFHAARTVVARKMFHEMIESETTVDIPVYNIILKGLCRNNCADEAIAMFQKLGAMNVKFDIGTLNTMINSLYKVGRKEEAKDLFAAISASRLVPNASTYSIMIINYLKEGSVEDAKHIFFINGQEWYSSQLSSYKLYHQNVVFLRKYHQNVVGKR

SEQ ID NO: 348 - protein, 209 aa, Triticum aestivum
MKSVGAEPDIVTYNTLVNGYCRNGRIDDGLTLFREMPHKRIKPDTVTYGIILDGLFHAARTVVARKMFHEMIESETTVDIPVYNIILKGLCRNNCADEAIAMFQKLGAMNVKFDIGTLNTMINSLYKVGRKEEAKDLFAAISASRLVPNASTYSIMIINYLKEGSVEDAKHIFFINGQEWYSSQLSSYKLYHQNVVFLRKYHQNVVGKR

SEQ ID NO: 349 - protein, 321 aa, Triticum aestivum; identical to SEQ ID NO: 347

SEQ ID NO: 350 - protein, 174 aa, Triticum aestivum
MPHKRIKPDTVTYGIILDGLFHAARTVVARKMFHEMIESETTVDIPVYNIILKGLCRNNCADEAIAMFQKLGAMNVKFDIGTLNTMINSLYKVGRKEEAKDLFAAISASRLVPNASTYSIMIINYLKEGSVEDAKHIFFINGQEWYSSQLSSYKLYHQNVVFLRKYHQNVVGKR

SEQ ID NO: 351 - protein, 209 aa, Triticum aestivum; identical to SEQ ID NO: 348

SEQ ID NO: 352 - protein, 209 aa, Triticum aestivum; identical to SEQ ID NO: 348

SEQ ID NO: 353 - protein, 654 aa, Triticum aestivum
MPRRSRPAGGILMGCFCGAHRPDLGLALFGRFLGTGLKTNKIVATTFLKCLCYAKRTDEAVNLLLRRMPELGCVPDAISYTIVLKSLCENSMSQRALDLLQMVAEGGGACSLNVVVYSTVIHGFFKEGETGKACNLFHEMIHQGVVPNVVTYSSIIDALCKARAMDKAELVLQQMVDSGAQPNNVTYTCMIHGYSTSGQLKEAAKMFRKMTTRGLVPDIVTCSSLMTFLCKHGRSKEAAEIFYSMTAKGLKPNIIAYSILLHGYATEGCFVDMNNLFNSMEDNGIAANCYVFNILIYAYAKRGMMDEAMLIFTEMREKGVSPDVVTYSTVIAAFCRLRRLANAMDKFNEMTDMGFQPDTTVYHSLIQGFCMHGDLVKAKGLVSEMMNKGIPRPDIAFFNSIINTLCKEGGVMDAQDVFDLVTAIDERPNIITFNSLIDGYCLVGEMDKAFGVLDAMKSVGAEPDIVTYNTLVNGYCRNGRIDDGLTLFREMPHKRIKPDTVTYGIILDGLFHAARTVVARKMFHEMIESETTVDIPVYNIILKGLCRNNCADEAIAMFQKLGAMNVKFDIGTLNTMINSLYKVGRKEEAKDLFAAISASRLVPNASTYSIMIINYLKEGSVEDAKHIFFINGQEWYSSQLSSYKLYHQNVVGKR

SEQ ID NO: 354 - protein, 664 aa, Triticum aestivum
MPRRSRPAGGILMGCFCGAHRPDLGLALFGRFLGTGLKTNKIVATTFLKCLCYAKRTDEAVNLLLRRMPELGCVPDAISYTIVLKSLCENSMSQRALDLLQMVAEGGGACSLNVVVYSTVIHGFFKEGETGKACNLFHEMIHQGVVPNVVTYSSIIDALCKARAMDKAELVLQQMVDSGAQPNNVTYTCMIHGYSTSGQLKEAAKMFRKMTTRGLVPDIVTCSSLMTFLCKHGRSKEAAEIFYSMTAKGLKPNIIAYSILLHGYATEGCFVDMNNLFNSMEDNGIAANCYVFNILIYAYAKRGMMDEAMLIFTEMREKGVSPDVVTYSTVIAAFCRLRRLANAMDKFNEMTDMGFQPDTTVYHSLIQGFCMHGDLVKAKGLVSEMMNKGIPRPDIAFFNSIINTLCKEGGVMDAQDVFDLVTAIDERPNIITFNSLIDGYCLVGEMDKAFGVLDAMKSVGAEPDIVTYNTLVNGYCRNGRIDDGLTLFREMPHKRIKPDTVTYGIILDGLFHAARTVVARKMFHEMIESETTVDIPVYNIILKGLCRNNCADEAIAMFQKLGAMNVKFDIGTLNTMINSLYKVGRKEEAKDLFAAISASRLVPNASTYSIMIINYLKEGSVEDAKHIFFINGQEWYSSQLSSYKLYHQNVVFLRKYHQNVVGKR

SEQ ID NO: 355 - protein, 664 aa, Triticum aestivum; identical to SEQ ID NO: 354

SEQ ID NO: 356 - protein, 788 aa, Triticum aestivum
MPRFSSTTSMSSLRLRLHARHSSSASQPSHSQGWDPHAAFAAATQRARSGSLTPADAHHLFDELLRQANPVQERPLNNLLAAIARAPASNACRNGPALAVALFSRISQGARLWVVQPTACTYGILMDCCCRARRPDLSLAFFGRLLKTGLEANQVVFNTLLKGLCHTKRADEALDVLLHRMPELGCTPDVVAYNTVIHGFFKEGHVSKACNLFHEMAQQGVKPNVVTYNSVIDALCKARAMDKAEVVLRQMIDDGVGPDNVTYSSLIHGYSSSGHWKEAVRVFKEMTSRRVTPNVHTYNMFITFLCKHGRSKEAAGIFDSMAMKGLKPDNVSYAILLHGYATEGCLVDMINLFNSMERDCILPNCRIFSILINAYAKSGKLDKAMLIFKEMQKQGVSPDAFTYSTVIHAFCKKGRLDDAVIKFNQMIDTGVRPDTAVYRSLIQGFCTHGDLVKAKEYVTEMMKKGMLPPDIMFFSSIMQNLCTEGRVTEARDILDLIVHIGMRPNVIIFNLLIGGYCLVRKMADALKVFDDMVSYGLEPCNFTYGILINGYCKNRRIDDGLILFKEMLHKGLKPTTFNYNVILDGLFLAGQTVAAKEKFDEMVESGVSVCIDTYSIVLGGLCRNSCSSEAITLFRKLSAMNVKFDITIVNIIIGALYRVERNQEAKDLFAAMPANGLVPNAVTYTVMMTNLIKEGSVEEADNLFLSMEKSGCTANSCLLNHIIRRLLEKGEIVKAGNYMSKVDAKSYSLEAKTVSLLISLFSRKGKYREHIKLLPTKYQFLEEAATVE

SEQ ID NO: 357 - protein, 778 aa, Triticum aestivum
MSNLRLLRRSSSSMSTTRSPLSRVWSPHSAFAAATERVRTGTLSQDDAHHLFDELLRQGNPVQERPLNNFLAALARAPASASCSDGPALAVALFGRLSRGAGQRVAQPNVFTYGVLMDCCCRACRTDLALAFFGRLLRTGLQAGQVVFNTLLKGLCHTKRADEALDVLLHRMPELGCTPDVVAYNTVIHGFFREGQVGKACDMFHGMAQKGVMPNVVTYNSVIDALCKARAMDKAETVLSQMVNDGVRPDNVTYNSLIHGYSSLGNWKEAVRVFKEMSRRFTPDVITCTSLMAFLCKNGKSKEAAEIFDSMAMKGLKRDTVSYAILLHGYATEGCLVDMINLFNSMATDCILPNCHIFNILINAYAKSGMMGEAMLIFKKMHEQGVSPDVVTYSTVIHAFCKMGSLDIAMDKFNQMVDMGVRPNAIVYHSLIQGFCTHGDLVKAKELVTEMRNKAMRPPDIKIFHSIMKNLCTEGRVIEARDILDLMVHIGMRPDVPIFNLLIGGYCLVHKMEDATKMFDDMVSYGLEPCNSTYGILINGYCKNGRIDDGLNLFKEMLRKGLKPTTFNYNVILDGLFLAGRTVAAKEKFDEMVESGVSVCIDTYSIVLGGLCRNNCTGEAITLSKKLSTMNVKFNIAIVNILIGAFFRVRRNQEAKDLFAAIPANGLVANVVTYSMMMINLIKEGSLEEADDLFLSMEKSGCTADSCMLNHIIRRLLERGEIVKAGNYMSKVDAKSYSLEAKTVSLLISLFLGKGRYREHMKLLPMKYQFLEEAATVE

SEQ ID NO: 358 - protein, 790 aa, Triticum aestivum
MPRFSSTTPMSPLRLRLRLRLGARHSSSTSHSSRSWDPHSAFAAAAERARSGNLTPEDAHHLFDELLRQGNPVQDRPLNKLLSALARAPASAACRNGPALAVNLFSRISQGARRRVAEPTACTYGILMDCCCRAHRLDLTLAFFGGLLKTGLKAGVIQVCTLLKGLCRAKRADEALDVLLHRMPELGCTPDVVAYTTVIHGFFKEGQVGKACNLFHGMAQQGVAPNLVTYNSVIDALCKAKAMDKAEYFLGQMVDDGVVPDNVTYNSLIHGYSSSGHWKEAVRVFKEMTSRRVTADVHTYNMFMTFLCKHGRSKEAAGIFDTMAIKGLKPDNVSYAIRLHGYATEGCLVDMINLFNSMERDCILPDCRIFSILINAYAKSGKLDKAMLLFKEMQKQGVSPDAVTYSTVIDAFCKKGQLDDAMIKFNQMIDTGVRQGTAVYGSLIQGFCTHGDLVKAKELLTEMMNKGIPPPDIKFFHSIMQNLCTEGRVIEAQDILDLMVHTGERPNVVTFSVLVGGYCLVRKMADASKVFDDMVSYGLEPCNIMYGILINGYCKNRRIDDGLILFKEMLHKGLKPTTFNYNVILNGLFLAGQTVAAKEKFDEMVESGVSVCIGTYSIVLGGLCRNGCSSEAITLFRKLSAMNVKFNITIVNTIIGAFYRVERNQEAKDLFAAVSANGLVADVFTYTIMMKNLIKEGSVEEADDLFLSMEKSGCTADSYMLNLIVRMFLGKGEIVKAGNYISKIDAKSYSLEAKTVSLLISLFSGKGKYREHIGLLPAKYRFREEAATVV

SEQ ID NO: 359 - protein, 792 aa, Triticum aestivum
MPRFSSTTPMSPPRLLLRLGARHSSSTSHPSRIWDPHAAFAAATQRARSGTLTTEDAHHLFDELLRQGNPVQERPLTNFLAALARAPASAFCSDGPALAVALFGRLSRGAGRRVAQPNVFTYGVLMDCCCRARRLDLAIAFFARLLKTGLEANQVIFCTLLKGLCHAKRSDEALDVVLHRMPELGCTPNVVAYTTVIHGFLKEGQVGKACNLFHGMAQQGVAPDVVTYNSVIDALCKARAMDKAEYFLREMVDNGVVPNNVTYNSLIHGYSSLGHQKEAVRVLKEMTRQGIIPDVITCTSLMTFLCKNGKSKEAAEIFDSMATKGLKHDAVSYAILLHGYATEGCLVDMINLFNSMDRDCILPNCHIFNILIYAYAKSGKLDKAMLIFRDMQKQGVSPDAFTYSTLIHAFCKKGRLDDAMIKFNQMVDTGVRQGTAVYGSLIQGFCTHGDLVKGKELVTEMMNKGIPPPDIMFFHSIMQNLCTEGRVVEARDILGLIAHIGMRPNVCTFNILIGGYCLVRKMEDASKIFHDMMSYGLEPSNVTYGILINGYCKNRRIDDGLILFKEMLRKGLKPTTFNYNIILDGLFLAGRTVAAKEKFDEMVESGVSMCISTYSIVLRGLCRNNCSGEAITLFQTLSAMDVKFNIRIVNIMIDAFFRVQRKQEAKDLFAAITANGLVANVFTYSLMMTNLIKEGSVEEADTLFLSMEMSGCTSNSWMLNLIIRGLLEKGEIVKAGCYMSKVDAKSYSLEAKTVSLLIYLFSGKGKYREHIRLLPTKYQFLEEAATVEWFAI

SEQ ID NO: 360 - protein, 792 aa, Triticum aestivum
MPRFSTTTPMSPPRLLLRLGARHSSSTSHPSRIWDPHAAFAAATQRARSGTLTTEDAHHLFDELLRQGNPVQERPLTNFLAALARAPASAFCSDGPALAVALFGRLSRGAGRRVAQPNVFTYGVLMDCCCRARRLDLAIAFFARLLKTGLEANQVIFCTLLKGLCHAKRSDEALDVVLHRMPELGCTPNVVAYTTVIHGFLKEGQVGKACNLFHGMAQQGVAPDVVTYNSVIDALCKARAMDKAEYFLREMVDNGVVPNNVTYNSLIHGYSSLGHQKEAVRVLKEMTRQGIIPDVITCTSLMTFLCKNGKSKEAAEIFDSMATKGLKHDAVSYAILLHGYATEGCLVDMINLFNSMDRDCILPNCHIFNILIYAYAKSGKLDKAMLIFRDMQKQGVSPDAFTYSTLIHAFCKKGRLDDAMIKFNQMVDTGVRQGTAVYGSLIQGFCTHGDLVKGKELVTEMMNKGIPPPDIMFFHSIMQNLCTEGRVVEARDILGLIAHIGMRPNVCTFNILIGGYCLVRKMEDASKIFHDMMSYGLEPSNVTYGILINGYCKNRRIDDGLILFKEMLRKGLKPTTFNYNIILDGLFLAGRTVAAKEKFDEMVESGVSMCISTYSIVLRGLCRNNCSGEAITLFQTLSAMDVKFNIRIVNIMIDAFFRVQRKQEAKDLFAAITANGLVANVFTYSLMMTNLIKEGSVEEADTLFLSMEMSGCTSNSWMLNLIIRGLLEKGEIVKAGCYMSKVDAKSYSLEAKTVSLLIYLFSGKGKYREHIRLLPTKYQFLEEAATVEWFAI

SEQ ID NO: 361 - protein, 792 aa, Triticum aestivum; identical to SEQ ID NO: 359

SEQ ID NO: 362 - protein, 792 aa, Triticum aestivum; identical to SEQ ID NO: 360

SEQ ID NO: 363 - protein, 788 aa, Triticum aestivum
MPRFSSTMPMSPPHLLLRLCARHSSSTSHPSRIWDPHAAFAAATQRARSGTLTTEDAHHLFDELLRQGNPVQERPLTNFLAALARAPASASCSDGPALAVALFGRLSRGAGRRVAQPNVFTYGVLMDCCCRARRLDLAIAFFGRLLKTGLEADRVVFSTLLKGLCHAKRSDEALDVLLHRMPEQGCTPYVVAYNTVIHGFFREGQVGKACDLFHGMAQQGVMPDVVTYNSVIDALCKARAMDKAEYFLRQMVDDGVVPNNVTYNSLIHGYSSSGHWKEAIRVFKEMTSRRITADVHTYNMFMTFLCKHGRSEEAAGIFDTMAMKGLKPDNVSYAIRLHGYATEGCLVDMINLFNSMERDCILPDCCIFNILINAYAKSGKLDKAMLIFNEMQKQGVSPDAVTYLPVIDAFCKKGRLDDAMIMFNQMIDTGVRPATAVYTSLIQGFCTHGDLVKAKELVTEMMNKGIPPPDIKFFHSIMQNLCTEGRVTEARDILGLIAHIGMRPNVCTFNILIGGYCLVRKMTDASKVFDDMVSYGLEPCNFTYGILINGYCKNRRIDDGLTLFKEMLHKGLKPKAFNYNVILDGLFLAGQTVAAKEKFDEMVESGVSVCIDTYSIVLGGLCRNSCSSEAITLFRKLSAMNVKFDITIVNTIIGAFYRVERNQEAKDLFAAIPASGLVPNVVTYTIMMKNLIKEGSVEEADNLFLSMEKSGCSANSYLLNHIIRRLLEKGERVKAGNYMSKVDAKSYSLEAKTVSLLISLFSRKGKYREHIKLLPTKYQFLEEAATVE

SEQ ID NO: 364 - protein, 742 aa, Triticum aestivum
MSPLRLHARRSYSTSHPPRSQGWDPHAAFAAATERARSGNLTSEDAHKLFDQLLLQANPVNMRLPNDLLTALARAPASAACSNGPALAVTLFTRLSRGARQPVVQPTACTYGILMDCCCRANRQDLALAFFARLLRTGLKAGVIEVNTLLKGLCRAKRADEALDILLHRMPELGCTPNVVAYTTVIHGFLKEGQVGKACNLFHGMAQQGVAPNVVTYNSVIDALCKARAMDKAEYFLRQMVDNGVVPDNVTYNSLIHGYSSSGHWKEAVRVLKEMTSQGIIPDIVSYRILLHGYATKGCLVDMINLFNSMARYCILPDCHIFNILINAYAKSGKLDKAMLIFKEMQKQGVSPDAVTYSTVIHAFCKNGRLDDAVIKFNQMIDTGVQPDTSVYNALIQGFSTNGDLVKAKELVTEMMNKGIPPPDIKFFHSIMQNLCTEGRLTEARDILGLIAHIGMRPNVCTFNILIGGYCLVRKMADASKVFDDMVSYGLEPCNFTYGILINGYCKNRRIDDGLILFKEMLHKGLKPTTFNYNVILDGLFLAGQTVAAKEKFNEMVESGVSVCIDTYSIVLGGLCTNNCCGEAITLFQKLSTMEVKFDIIIVNTMIDAFYRVRQNQEAKDLFAAVSANGLVANVFTYTIMMTNLIKEGSLEEADNLFLSMEKSGCTADSFMLNLIIRRLLEKGEIVKAGNYISKVDAKSYSLEAKTVSLLISLFSGKGKYRAHIRLLPSKYQFREEAGTVE

SEQ ID NO: 365 - protein, 287 aa, Triticum aestivum
MRPNVCTFNILIGGYCLVRKMADASKVFDDMVSYGLEPCNFTYGILINGYCKNRRIDDGLILFKEMLHKGLKPTTFNYNVILDGLFLAGQTVAAKEKFNEMVESGVSVCIDTYSIVLGGLCTNNCCGEAITLFQKLSTMEVKFDIIIVNTMIDAFYRVRRNQEAKDLFAAVSANGLVANVFTYTIMMTNLIKEGSLEEADNLFLSMEKSGCTADSFMLNLIIRRLLEKGEIVKAGNYISKVDAKSYSLEAKTVSLLISLFSGKGKYRAHIRLLPSKYQFREEAGTVE

SEQ ID NO: 366 - protein, 289 aa, Triticum aestivum
MQKQGVSPDAVTYSTVIHAFCKNGRLDDAVIKFNQMIDTGVQPNTSVYNALIQGFSTNGDLVKAKELVTEMMNKGMHPPDIKVFHSVMQNLCTEGRVTEARDILDLIVHIGMRPDVFTFTSLIGGYCLVRNMEDASKIFDDMVSYGLEPSNITYGILINGYCKNKRIDEGLILFKEMLRKGLKPTTINYNVILDGLFLAGRTVAAKEKFNEMVESGVSVCIDTYSIVLGGLCTNNCCGEAITLFQKLSKMNVKFNIRIVNIMIDAFFKVQRKQEAEDLFAAISANGLVC

SEQ ID NO: 367 - protein, 769 aa, Triticum aestivum
MPRRLPPVLLPLHTKAMPRLSSTTPMSPLRLRLRLRARHSASTSHSSRSWEPHAAFAAATERARSCNLTPEDAHHLFDELLRQAKPVQERPLNNLLAALARAPASAACSDGPALAVNLFGRISQGARRRVAHPTACTYGILMDCCCRAHRLDLAFAFFGHLLRTGLKAGVIHVCTLLKGLCRAKRADEALDVLLHRMPELGCTPDVVAYTTVIHGFFKEGQVSKACNLFHEMALQGVAPNVVTYSSVIDALCKARAMDKAEYFLRQMVHNGVLANNVTYNSLIHGYSSSGHWKEAVRVLKEMTSQGIIPDIVSYRILLHGYATEGCLVDMINLFNSMARYCILPDCHIFNILINAYAKSGKLDKAMLIFKEMQKQGVSPDAVTYSTVIHAFCKNGRLDDAVIKFNQMIDTGVQPNTSVYNALIQGFSTNGDLVKAKELVTEMMNKGMHPPDIKVFHSVMQNLCTEGRVTEARDILDLIVHIGMRPDVFTFTSLIGGYCLVRNMEDASKIFDDMVSYGLEPSNITYGILINGYCKNKRIDEGLILFKEMLRKGLKPTTINYNVILDGLFLAGRTVAAKEKFNEMVESGVSVCIDTYSIVLGGLCTNNCCGEAITLFQKLSKMNVKFNIRIVNIMIDAFFKVQRKQEAEDLFAAISANGLVANVFTYSLMMTNLIKEGSAEEADTLFLSMEKSGCTANSWMLNLIIRRLLEKGEIVKAGNYMAKVDAKSYSLEAKTVSLLISLFSGKGKYREHIRLLPTKYQFREEAATVE

SEQ ID NO: 368 - protein, 783 aa, Triticum aestivum
MARLCFTTPMPHLRRRYSSFTSPPSRRWDPRPAFAAATERVRAGTLSPEDAHHLFDELLLQANPVPERSLNGFLAALARAPSSATLRDGPSLALALFNRVCREEAGPPVAPPTVRTYNILMDSCCRARRPDLGLAFFGRFLRAGLKVNLIVASTLLKCLCHARRTDEAVNMLLHRMSEFGCVPDAISYSIVLKGLCDNSRSQQALDLLQMVRKGGACSLSVVAYSIIIHGFFKEGEVSKACNLFHEMMQQGVVPDVVTYSSIIDALCKVRAMDKAKLVLQQMVNNGVRPNMYTWNSFMYSLCKHGRSKEAAEFFNSMTAKGLKPDIVAYSTLLHGYATEGCLTDMINFFNSMERNGIVANCKVFTILIDGYAKCGMTDEAMLIFTKMQEQGVSPNVFTYAIVTAALCRMGRLSDAMEKLNEMIAMGLQPNKVVYHSLIQVFCTHGDLVKAKALVSEMMNKGIPRPNIVFFNSVINSLCKEGRVTDAHDIFDLAINIGERPDVITFNSLIDGYCLAGKMDKAFGVLDAMVSSGIEPNVVTYNTLVGGYSRNGRIDDGLTLFREMMHIKIKPTTATYGAILHGLFRAGRTFSAKKMFNEMIESGTTVNISIYAIILGGLCRNNCVDEAIVLFEKLGAMNVKLDVGIFNTMINAMYAVKGREEAEDLFAAISANGLVPNASSYGVMITNLLREGLVEEADNMFSSMDKSGCAPSSRLLNNIIRMLLEKGEISKAGNYMSKVDGKNISLEASTTSLLLSLFSREGKYREQIKLLPAKYQFFDGSSHS

SEQ ID NO: 369 - protein, 783 aa, Triticum aestivum; identical to SEQ ID NO: 368

SEQ ID NO: 370 - protein, 783 aa, Triticum aestivum; identical to SEQ ID NO: 368

SEQ ID NO: 371 - protein, 783 aa, Triticum aestivum; identical to SEQ ID NO: 368

SEQ ID NO: 372 - protein, 783 aa, Triticum aestivum; identical to SEQ ID NO: 368

SEQ ID NO: 373 - protein, 783 aa, Triticum aestivum; identical to SEQ ID NO: 368

SEQ ID NO: 374 - protein, 776 aa, Triticum aestivum
MSPPRLRLHARHSSSASQPSRSQGWDPHAAFAAAAECARSGNLTPEDAHNLFDQLLQHGNPVQERALNSLLAALARTPASAACRDGPALTVALFSRISKGRVAQPNVFTYGVLMADCCCRAHRPDLTLAFFGRFLRTGLEADQVVFNTLLKGLCHAMRAGEAVNVLLHRMPDLGCTPNVVAYNTVIHGFFREGQAGKACDMFHGMAQKGVMPNVVTYNSVIDALCKARAMDKAETVLSQMVNDGVRPDNVTYNSLIHGYSSLGNWKEAVRVFREMSQRFTPDVVTCTSLMAFLCKNGKSKEAAEIFDSMATKGLKRDTVSYAILLHGYATEGCLVDMDNLFNSMVRGCIVPDCHIFNILIDAYAKSEKLDKAMLMFKEMQKHGVSPNAVTYPTVIHAFCKMGSLDIAMDKFNQMVDMGVRPNAIVYHSLIQGFCTHGDLVKAKELVTEMRNKAMRPPDIKFFHSIMQNLCTEGRVIEARDILDLMLHIGMRPDVPIFNLLIGGYCLVREMEDATKMFDDMMSYGLEPCNNTYGILINGYCKNGKIDDGLNLFKEMLHKGLKPTTFNYNVILDGLFLAGRTVAAKVKFNEMVESGVSVCIDTYSIVLGGLCRNNCTGEAITLSKKLSTMNVKFNIAIVNILIGPFFRVRRNQEAKDLFAAIPSNGLVANVVTYSIMMTNLVKEGSVEEADTLFLSMEKSGCTANSCMLNHIIRRLLEKGEIVKARNYMSKVDAKSYSLEAKTVSLLISLFSGKGKYRERKKLLPMKYQFLEEAATVE

SEQ ID NO: 375 - protein, 323 aa, Triticum aestivum
MLPPDIAFFNSIMQNLCTEGRVIEARDVLGLIAHIGMRPDVCTFNILIGGYCLVGKMEDASKIFDDMMSYGLEPSNITYGILINGYCKNRRIDDGLILFKEMLHKGLKPTTFNYNVILDGLFLAGRTVAAKEKFDEMVESGVSVCIGTYSIVLGGLCRNNCSGEAITLFQKLSTMDVKFNITIVNIMIDAFYRVQRNQEAKDLFAAVSANGLVANVFTYTIMMKNLIKEGSVEEADDLFLSMEKSGCTADSYMLNLIVRMLLEKGELVKAGNYMSKVDAMSYSLEAETVSLLISLFSGKGKYREHIGLLPAKYRFREEAATVV

SEQ ID NO: 376 - protein, 663 aa, Triticum aestivum
MDCCCRAHRLDLAFAFFGRLLRTGLKAGVIQVCTLLKGLCRAKRADEALDVLLHRMPELGCTPDVVAYTTVIHGFFKEGQVGKACNLFHGMAQQGVAPNLVTYNLVIDALCKAKAMDKAEYFLGQMVDDGVVPDNVTYNSLIHGYSSSGHWKEAVRVFKEMTSRRVTADVHTYNMFMTFLCKHGRSKEAAGIFDTMAMKGLKPDNVSYAILLHGYATEGSLVDMINLFNSMERDCILPDCCIFNILINAYAKSGKLDKAMLIFNEMQKQGVSPNAVTYSTIIHAFCKNCRLDDAVIKFNQMIDTGVRQGTAVYRSLIQGFCTHGDLVKAKELLTEMMNKGMLPPDIAFFNSIMQNLCTEGRVIEARDVLGLIAHIGMRPDVCTFNILIGGYCLVGKMEDASKIFDDMMSYGLEPSNITYGILINGYCKNRRIDDGLILFKEMLHKGLKPKTFNYNVILDGLFLAGRTVAAKEKFDEMVESGVSVCIGTYSIVLGGLCRNNCSGEAITLFQKLSTMDVKFNITIVNIMIDAFYRVQRNQEAKDLFAAVSANGLVANVFTYTIMMKNLIKEGSVEEADDLFLSMEKSGCTADSYMLNLIVRMLLEKGGLVKAGNYMSKVDAMSYSLEAETVSLLISLFSGKGKYREHIGLLPAKYRFREEAATVV

SEQ ID NO: 377 - protein, 344 aa, Triticum aestivum
MDCCCRAHRLDLAFAFFGRLLRTGLKAGVIQVCTLLKGLCRAKRADEALDVLLHRMPELGCTPDVVAYTTVIHGFFKEGQVRKACNLFHGMAQQGVAPNLVTYNLVIDALCKAKAMDKAEYFLGQMVDDGVVPDNVTYNSLIHGYSSSGHWKEAVRVFKEMTSRRVTADVHTYNMFMTFLCKHGRSKEAAGIFDTMAMKGLKPDNVSYAILLHGYATEGSLVDMINLFNSMERDCILPDCCIFNILINAYAKSGKLDKAMLIFNEMQKQGVSPNAVTYSTIIHAFCKKGRLDDAVIKFNQMIDTGVRQGTAVYRSLIQGFCTHGDLVKAKELLTEMMNKRYASS

SEQ ID NO: 378 - protein, 788 aa, Triticum aestivum
MPRFSSTTPMSPPRLLLRLRARHSSSTSHPSRIWDPHAAFAAATERGRSGNLTPEDAHHLFDELLWQGNPVQDRPLNKLLSALARAPASAACRNGPALAVALFSRISQGARRRVAEPTACTYGILMDCCCRAHRLDLALAFFARLLKTGLEANQVIFNTLLKGLCHAKRSDEALDVLLHRMPELGCTPGVVAYNTVIHGFFKEGQVGKACNLFHEMVQQGVMPDVVTYNSVTDALCKARGMDKAEYFLRQMVDDGVVPDTVTYNSLIHGYSSSGHWKEAVRVFKEMTSRRVTPDVHTYNMFITFLWKHGRSKEAAGIFDSMAMKGLKPDNVSYAILLHGYATEGCLVDVINLFNSMATDCILPNCHIFNILINAYAKSGKLDKAMLIFREMQKQGVSPDAFTYSTLIHAFCKKGRLDDAMIKFNQMVDTGVRQGTAIYGSLIQGFCTHGDLVKGKELVTEMMNKGIPPPDIMFFHSIMQNLCTEGRVIEARDILGLIAHIGMRPNVCTFTILIGGYCLVCKMEDATKMFEDMVSFGLEPCNITYGILINGYCKNRRIDDGLILFQEMLHKGLKPTTFNYNVILDGLFLAGRTVAAKEKFDEMVESGVSVCTDTYSIVLAGLCRNNCSSEVIMLFQKLRAMNMEFNIRIVTIMIDAFYKVRRNQEAKDLFAAIPSNGLVANVVTYSIMMKNLIKEGSVEEADTLFLSMEKSGCTATPWMLNHIIRRLLERGEIVKAGNYMSKVDAKSYSLEAKTVSLLISLFSGKGKYREHIKLLPMKYQFLEEAATVE

SEQ ID NO: 379 - protein, 785 aa, Triticum aestivum
MSPLRLRLRLRPRLHARHSYSTSHPPRGQGWDPHASFAAATERARSGNLSSEDAHHLFDQLLLQANPVNMRLPNDLLTALARAPASASCSNGPALAVALFSRLSQGARQRVVQPTACTYGILMDCCCRANRQDLALAFFARLLRTGLKAGVIEVNTLLKGLCRAKRADEALDILLHRMPELGCTPNVVAYNTVIHGFFQEGQAGKACSLFHEMAQQGVAPSLVTYNSVIDALCKARAMDKAEYFLGQMVDDGVIPDNVTYNSLIHGYSSSGHWKEAVRVFKEMTSRRVKPNVHTHNMFMTFLCKHGRSKEAAGIFDTMAMKGLKHNNVSYAILLHGYATEGCLVDMINLFNSMERYCILPDCRIFNILIHAHAKSGKLDKAMLIFNEMQKQGVSPNAVTYSTIIHAFCKKGRLDDAVIKFNQMIDTGVRQGTAVYRSLIQGFCTHGDSVKAKELLTEMMNKGMLPPDIAFFNSIMQNLCTEGRVIEARDVLGLIAHIGMRPDVCTFNILIGGYCLVGKMEHASKIFDDMMSYGLEPSNITYGILINGYCKNRRIDDGLILFKEMLHKGLKPTTFNYNVILDGLFLAGRTVAAKEKFDEMVESGVSVCIGTYSIVLGGLCRNNCSGEAITLFQKLSTMDVKFNIIIVNIMIDAFYKVQRNQEAKDLFAAVSANGLVANVFTYTIMMKNLIKEGSVEEADDLFLSMEKSGCTADSYMLNLIVRMLLGKGEIVKAGNYISKIDAKSYSLEAKTVSLLISLFSGKGKYREHIGLLPAKYRFREEAATVV

SEQ ID NO: 380 - protein, 328 aa, Triticum aestivum
  misc_feature (15)..(15): Xaa can be any naturally occurring amino acid
  misc_feature (64)..(64): Xaa can be any naturally occurring amino acid
MMKKGMLPPDIKFFXSIMQNLCTEGRVIEARDVLGLIAHIGMRPDVCTFNILIGGYCLVGKMEXASKIFDDMMSYGLEPSNITYGILINGYCKNRRIDDGLILFKEMLHKGLKPTTFNYNVILDGLFLAGRTVAAKEKFDEMVESGVSVCIGTYSTVLGGLCRNNCSGEAITLFQKLSTMDVKFNIIIVNIMIDAFYKVQRNQEAKDLFAAVSANGLVANVFTYTIMMKNLIKEGSVEEADDLFLSMEKSGCTADSYMLNLIVRMLLGKGEIVKAGNYISKIDAKSYSLEAKTVSLLISLFSGKGKYREHIGLLPAKYRFREEAATVV

SEQ ID NO: 381 - protein, 785 aa, Triticum aestivum; identical to SEQ ID NO: 379

SEQ ID NO: 382 - protein, 792 aa, Triticum aestivum
MPRFSSTTPMSPPRLLLRLRARHSSSTSHPSRIWDPHAAFAAATQRARSGTLTTEDAHHLFDELLRQGNPVQERPLNNFLAALARAPASASCSGGPALAVALFGHLSRGAGRRVAQPNVFTYGVLMDCCCRACRPDLALAFFGRLLKTGLEADQVVFSTLLKGLCHAKRADEALDVLLHRMTELGCTPNVVAYNTVIHGFFREGQVGKACALFHGMAQQGVTPDVVTYNSVIDPLCKAKAMDKAEYFLCQMVDNGAVPNNVTYNSLIHGYSSSGHSKEAVRVLKEMTSKGIIPDVFTCNSLMASLCKNGRSKEAAEIFDSMSMKGLKPNTVSYAIRLHGYATEGCLIDMINLFNSMERDCILPDCHIFSILINAYAKSGKLDKAMLIFKKMRKQGVSPNAVTYSTVIDAFCKKGRLDDAVIEFNQMIDTGVRPNTAVYCSLIQGFCTHGGLVKAKEYVTEMMNKGMLPPDIMFFHSVMQNLCTEGRVIEARDILGLIAHIGMTPDACTFNILIGGYCLVCKMEDSTNMFNDMVSYGLEPCNITYGILINGYCKNRRIDEGLILFKEMLRKGLKPTTFNYNVILDGLFLAGRTVAAKEKFNEMVESGVSMWISTYSIVLRGLCRNNCSGEAITLFQKLSAMDVKFNIRIVNIMIDAFFRVQRKQEAKDLFAAITANGLVADVFTYSLMMTNLIKEGSVEEADTLFLSMEMSGCTSNSWMLNLIIRRLLEKGEIVKAGCYMSKVDAKSFSLEAKTVSLLISLFSGKGKYREHIRLLPTKYQFLEEAATVEWFAT

SEQ ID NO: 383 - protein, 792 aa, Triticum aestivum; identical to SEQ ID NO: 382

SEQ ID NO: 384 - protein, 792 aa, Triticum aestivum; identical to SEQ ID NO: 382

SEQ ID NO: 385 - protein, 792 aa, Triticum aestivum; identical to SEQ ID NO: 382

SEQ ID NO: 386 - protein, 792 aa, Triticum aestivum; identical to SEQ ID NO: 382

SEQ ID NO: 387 - protein, 792 aa, Triticum aestivum; identical to SEQ ID NO: 382

SEQ ID NO: 388 - protein, 771 aa, Triticum aestivum
MPTARLSSIFTSSFRDPSRAPLAALAAATERVRAGTLTREDAHHLFGELLGQAAAVPERGLNNFLATLARAPPSPACSDGPGLAIALFNRMSRGAGARVVSPTLCTYSILMDCCCRAGRPDLVVAFFGRLIRLGLRLEVISVSNLLKGLCQAKRTNEAVALLLHGTPELDCVPNVFSYSIVINGCFKEGEVDKACNLFHGMIQLGVQPNVVIYTSIIDALSKCRAMDKAEVVLQQMVDQGIEPNIRTYTTLIHGYSASGQWKAAVRVFKEMASVGVLPNAVTLNSFMDSLCKHRRTKEARVIFDSMAAKGQKPDVVSYSTMLSGYAKEGCFDDMTCLFNSMLQNGVVPNHHIFNILINAYAKRGLMDAAMHMFEVMRQQGVNPDVFSYQIVMDSLCKMGRMDAALDKFNQMVNQGVSPDIVVYRCLVLGSCSHGDFEKAKELISEAVNRGLCSNSVFFYPVINDLCKEGKVKEAQDMFDFIVGIGQRPDVIMYNSLMDGYCLVGKVEEALRVLDAMKSVGLQPDAFTYGILLNGYCKIGKIADGLSLFREMSLNGVKPMTIMYNIILHGLFFSGRTVSAKEIFHTMNASGIPVGVDTYNIVLSGLCKNNCTDEAIELFKKLRAMNVKINVIILNTMISAMFKTRRIEEAKDLFATISAIGLVPSVVTYSVMMTNFIKEGLLAEADDMFLAMEKASCAPNSSLLNQVVRALLEKGAVVKAATYLAKLDAKQLSVEASTISLIVSLFSGEGKLREHVELLPVKYQPPESSADN

SEQ ID NO: 389 - protein, 771 aa, Triticum aestivum; identical to SEQ ID NO: 388

SEQ ID NO: 390 - protein, 334 aa, Triticum aestivum
MPTARLSSIFTSSFRDPSRAPLAALAAATERVRAGTLTREDAHHLFGELLGQAAAVPERGLNNFLATLARAPPSPACSDGPGLAIALFNRMSRGAGARVVSPTLCTYSILMDCCCRAGRQDLVVAFFGRLIRLGLRLEVISFSNLLKGLCQAKRTNEAVALLLHGTPELDCVPNVFSYNIIINGCFKEGEVDKACNLFHGMIQLGVQPNVVIYTSIIDALSKCRAMDKAEVVLQQMVDQGIEPNIRTYTTLIHGYSASGQWKAAVRVFKEMASVGVLPNAVTLNSFMDSLCKHIEGQRKLELFLTPWLQRAKNLMSSPTLLCLAGMRKKDASMI

SEQ ID NO: 391 - protein, 771 aa, Triticum aestivum; identical to SEQ ID NO: 388

SEQ ID NO: 392 - protein, 361 aa, Triticum aestivum
MVNQGVSPDIVVYRCLVLGSCSHGDFEKAKELISEAVNRGLCSNSVFFYPVINDLCKEGKVKEAQDMFDFIVGIGQRPDVIMYNSLMDGYCLVGKVEEALRVLDAMKSAGLQPDAFTYGILLNGYCKIGKIADGLSLFREMSLNGVKPTTIMYNIILHGLFFSGRTVSAKEIFHTMNASGIPVGVDTYNIVLSGLCKNNCTDEAIELFKKLRAMNVKINVIVLNTMISAMFKTRRIEEAKDLFATISAIGLVPSVVTYSVMMTNFIKEGLLAEADDMFLAMEKASCAPNSSLLNQVVRALLEKGAVVKAATYLAKLDAKQLSVEASTISLIVSLFSGEGKLREHVELLPVKYQPPESSADN

SEQ ID NO: 393 - protein, 771 aa, Triticum aestivum; identical to SEQ ID NO: 388

SEQ ID NO: 394 - protein, 771 aa, Triticum aestivum
MPTARLSSIFTSSFRDPSRAPLAALAAATERVRAGTLTREDAHHLFGELLGQAAAVPERGLNNFLATLARAPPSPACSDGPGLAIALFNRMSRGAGARVVSPTLCTYSILMDCCCRAGRPDLVVAFFGRLIRLGLRLEVISVSNLLKGLCQAKRTNEAVALLLHGTPELDCVPNVFSYSIVINGCFKEGEVDKACNLFHGMIQLGVQPNVVIYTSIIDALSKCRAMDKAEVVLQQMVDQGIEPNIRTYTTLIHGYSASGQWKAAVRVFKEMASVGVLPNAVTLNSFMDSLCKHRRTKEARVIFDSMAAKGQKPDVVSYSTMLSGYAKEGCFDDMTCLFNSMLQNGVVPNHHIFNILINAYAKRGLMDAAMHMFEVMRQQGVNPDVFSYQIVMDSLCKMGRMDAALDKFNQMVNQGVSPDIVVYRCLVLGSCSHGDFEKAKELISEAVNRGLCSNSVFFYPVINDLCKEGKVKEAQDMFDFIVGIGQRPDVIMYNSLMDGYCLVGKVEEALRILDAMKSVGLQPDAFTYGILLNGYCKIGKIADGLSLFREMSLNGVKPMTIMYNIILHGLFFSGRTVSAKEIFHTMNASGIPVGVDTYNIVLSGLCKNNCTDEAIELFKKLRAMNVKINVIILNTMISAMFKTRRIEEAKDLFATISAIGLVPSVVTYSVMMTNFIKEGLLAEADDMFLAMEKASCAPNSSLLNQVVRALLEKGAVVKAATYLAKLDAKQLSVEASTISLIVSLFSGEGKLREHVELLPVKYQPPESSADN

SEQ ID NO: 395 - protein, 771 aa, Triticum aestivum; identical to SEQ ID NO: 388

SEQ ID NO: 396 - protein, 754 aa, Triticum aestivum
MPRFSSTPPMSPRRLRVGLGARHSSSTSHPSRSWEPHAAFAAATERARSGNLTPEDAHHRFDELLRQANPVQERPLNKRLSALAGAPASAACRNGPALAVALFSRISQGARRRVAHPTACTYGILMDCCCRAHRLDLAFAFFGRLLRTGLKAGVIQVCTLLKGLCRAKRADEALDVLLHRMPELGGCTPNVVAYTTVIHSFFKEGQVSKACNLFHEMALQGVTPDVVTYSSVIDALCKARAMDKAEYFLRQMVHNGVLPNNVTYNSLIHGYSSSGHWKEAVRVLKEMTSQGIIPDIISYRILLHGYATEGCLVDMINLFNSMARYCILPDCHIFNILINAYAKSGKLDKAMLIFKEMQKQGVSPDAVTYSTVIHAFCKNGRLDDAVIKFNQMIDTGVQPNTSVYNALIQGFSTNGDLVKAKELVTEMMNKGMHPPDIKVFHSVMQNLCTEGRVTEARDILDLIVHIGMRPDVFTFTSLSGGYCLVRNMEDASKIFDDMVSYGLEPSNITYGILINGYCKNKRIDEGLILFKEMLRKGLKPTTINYNVILDGLFLAGRTVAAKEKFNEMVESGVSVCIDTYSIVLGGLCTNNCCGEAITLFQKLSKMNVKFNIRIVNIMIDAFFKVQRKQEAEDLFAAISANGLVANVFTYSLMMTNLIKEGSAEEADTLFLSMEKSGCTANSWMLNLIIRRLLEKGEIVKAGNYMAKVDAKSYSLEAKTVSLLISLFSGKGKYREHIRLLPTKYQFREEAAIVE

SEQ ID NO: 397 - protein, 790 aa, Triticum aestivum
MISHSSSSQSSRPTHCKKQCYCTRRLPLVLLPLHTKAMPRLSSTTPMSPLRLRLRLRARHSASTSHSSRSWEPHAAFAAATERARSGKLTPEDAHHLFDELLRQAKPVQERPLNNLLAALARAPASAACSDGPALAVNLFGRISQGACRRVAHPTACTYGILMDCCCRAHRLDLAFAFFGRLLRTGLKAGVIQVCTLLKGLCRAKRADEALDMLLHRMPELGCTPNVVAYTTVIHGFFKEGQVSKACNLFHEMALQGVTPDVVTYSSVIDALCKARAMDKAEYFLRQMVHNGVLPNNVTYNSLIHGYSSSGHWKEAVRVLKEMTSQGIIPDIVSYRILLHGYATEGCLVDMINLFNSMARYCILPDCHIFNILINAYAKSGKLDKAMLIFKEMQKQGVSPDAVTYSTVIHAFCKKGRLDDAVIKFNQMIDTGVQPKTSVYNALIQGFSTNGDLVKAKELVMEMMNKGMHPPDIKVFHSVMQNLCTEGRVTEARDILDLIVHIGMRPDVFTFTLLIGGYCLVRNMEDASKIFDDMVSYGLEPSNITYGILINGYCKNKRIDEGLILFKEMLRKGLKPTTINYNVILDGLFLAGRTVAAKEKFNEMVESGVSVCIDTYSIVLGGLCTNNCCGEAITLFQKLSKMNVKFNIRIVNIMIDAFFKVQRKQEAEDLFAAISANGLVANVFTYSLMMTNLIKEGSAEEADTLFLSMEKSGCTANSWMLNLIIRRLLKKGEIVKAGNYMAKVDAKSYSLEAKTVSLLISLFSGKGKYREHIRLLPTKYQFREEAAIVE

SEQ ID NO: 398 - protein, 430 aa, Triticum aestivum
MKSNGIAADCRVFTILIDAYAKRGMMDDAMHIFAEMREKGVSPNVVTYATVIGALCRLGRLADAMDRFNEMTDMGVQPNTAVYHSLIQGFCMHGDLGKAKELVSDMISKGIPRPNIVFFNSVINYLCKEGRIMDAQDIFELVIIIDGKPDVITFNSLIDGHCLVSKMDKAFGVLGAMLSAGIEPNVVTYNTLVNGYSRNGRIDDGLTLFRQMPRKRIKPDSATYGIILDGLFRAGRTVAARKMFHDMIESGITVSISTYNIILAGLSRNNCAEEAIDLYQKLVAMNVKFNISIINTMINAMYKVKRKEEAKDLFAAISASGLVPNASTYGVMIINILKDGAVEDANNMFSAMDRNGIAPCSRLIDSIIRILLEKGEITMAGLYLLKLDGKNMLLEASTTSLMLSLFSRKGKYKEDVKFLPAKYQFFDGFG

SEQ ID NO: 399 - protein, 430 aa, Triticum aestivum; identical to SEQ ID NO: 398

SEQ ID NO: 400 - protein, 780 aa, Triticum aestivum
MSRLRLRRSSTTPMFHILRRSSSSTSISPPSRSWSPEGAFAAATARLSTGTLSPEEAHHLFDELLRQATPVPSRSLNGFLATLARAPASAACSRDGPALALALALFNRVCAEEADPRVAPLTVHTYGILMDCCCRARRPDLGLALFARFLRTGLKTNEIIANTFLKCLCYAKRTDEAINLLLHRMPELGCVPDAISYTIVLKSLCENSMSQRALDLLQMVAEGGGACSLNVVAYSTVIHGFFKEGETGKACNLFHEMTRQGVVPNVVTYSSIIDALCKSRAMDKAELVLQQMVDSGAQPNNVTYNCMIHGYSTSGQLKEAAKMFRKMTSHGLVPNAVTCSSLMTSLCKHGRSKEAAEIFYSMTAKGHKPDAVSYRILLHGYANEGCFADMIDLFNSMKSNGIAADCRVFTILIDAYAKRGMMDDAMHIFAEMREKGVSPNVVTYATVIAALCRLGRLADAMDRFNEMTDMGVQPNTAVYHSLIQGFCMHGDLGKAKELVSDMISKGIPRPNIVFFNSVINYLCKEGRIMDAQDIFELVIIIDGKPDVITFNSLIDGHCLVGKMDKAFGVLDAMLSAGIEPNVVTYNTLVNGYSRNGRIDDGLTLFRQMPRKRIKPDSATYGIILDGLFRAGRTVAARKMFHDMIESGITVSISTYNIILAGLSRNNCAEEAIDLYQKLVAMNVKFNISIINTMINAMYKVKRKEEAKDLFAAISASGLVPNASTYGVMIINILKDGAVEDANNMFSAMDRNGIAPCSRLINSIIRILLKKVRSPWPDFIC

SEQ ID NO: 401 - protein, 780 aa, Triticum aestivum; identical to SEQ ID NO: 400

SEQ ID NO: 402 - protein, 780 aa, Triticum aestivum; identical to SEQ ID NO: 400

SEQ ID NO: 403 - protein, 430 aa, Triticum aestivum
MKSNGIAADCRVFTILIDAYAKRGMMDDAMHIFAEMREKGVSPNVVTYATVIGALCRLGRLADAMDRFNEMTDMGVQPNTAVYHSLIQGFCMHGDLGKAKELVSDMISKGIPRPNIVFFNSVINYLCKEGRIMDAQDIFELVIIIDGKPDVITFNSLIDGHCLVSKMDKAFGVLGAMLSAGIEPNVVTYNTLVNGYCRNGRIDDGLTLFRQMPRKRIKPDSATYGIILDGLFRAGRTVAARKMFHDMIESGITVSISTYNIILAGLSRNNCAEEAIDLYQKLVAMNVKFNISIINTMINAMYKVKRKEEAKDLFAAISASGLVPNASTYGVMIINILKDGAVEDANNMFSAMDRNGIAPCSRLIDSIIRILLEKGEITMAGLYLLKLDGKNMLLEASTTSLMLSLFSRKGKYKEDVKFLPAKYQFFDGFG

SEQ ID NO: 404 - protein, 780 aa, Triticum aestivum
MQTGRLSSIFTSNATSSFRAPSPQPRPPLAALAAATERARAGTLRPEEAHHLFDELLSQAAPVPERGLNNFFAALARAPPSAACGDGPALAIALFNRMSRGVGPWMASPAGCTYSILMDCCCRAGRPDLVVAFFGRLLRLGLRLEVISFNNLLKGLCHAQRTNEALDVLLHRTPELDCVPDVFSYSIVINSCFKEGEVDKACNLFHEMIQLGVQPDVAIYTSIIDALSKAGAMDKAEVVLQQMVDQGIEPDVMTYTSLIHGYSGSGQWKAAVRVFKEMASAGVLPNAFTLNSFMDSLCKHRRTKEARVIFDSMAAKGQKLNIVSYSIMLNGYAKEGCFDDMTGLLNLMLQNGVVPNHHIFNILINAYAKRGLMDEAMHMFEVMRQQGVNPDVVDYLVIMDSLCKMGRMDAALDKFNQMVNQGVSPNKAIYQCLVLGSCSHGHFVKAKELISEAINRGLFSNSVFFYPVINDLCKEGKVKEAQDMFDFILGIGQRPDVIMYNSLMDGYCLVGKVEEAVRVLDAMKSAGLQPTAVTYAILLNGYCKIGRIADGLSLFREMSLSGVKPTTIMYNIILDGLFRSGRTVSAKEKFRTMSESGIPVGIGTYNIILHGFCRSNCTDEAIELFKKLCAMNVKIDVITLNTMISVMFKTRRIEEAKDLFATISAIGLVPSVVTYSVMMTNFIKEGLLAEADDMFLAMEKAGCAPDCRLLNHVVRVLLEKGAVVKAATYLAKLDAKELSLEASTVSLIVSLFSRRGKLREHVKLLPVKYQPPEILLGTSY

SEQ ID NO: 405 - protein, 761 aa, Triticum aestivum
MPRFSSTTSMSSLRLRLRLRLHACHSSSASQPSRSQGWDPHAAFAVATECARSGNLTPEGAHNLFDELLRQGNPVLGRPLNNLLAALARAPASSSCRDGPALAVALFSRISQGARLRVVHPTACTYSILMDCCCRARHLDLALAFFGRLLRTGLKAGAIEVNILLKSLCHAKRADEAMEVLLHRMPELGCTPDSVAYNTVIHGFFKEGQVGRAMDKAEYFLREMVDNGVIPNNVTYNSLIHGYSSSGYQKEAVRVLKEMTSQGIIPDVFTCNSLMASLSKNGRSKEAAEIYDSMAMKGLEPDIVSYNTRLHGYATEGCLVDMTNLFNSMTRDGIRPNCHTLNILINAYAKFGMMDEAMLIFKGMRKQGVSPDVVTYSTVIHAFCKMGSLDIAMDKFKQMTDMGVRPNPIVYHSLIQGFCTHGDLVKAKELVTEMRNKGMRPPDIKVFHLVMQNLCTEGRVTKARDILDLIVRIGMRPDVFIFNILIGGYCLVRKMADASKIFDDMVSYGLEPSNITYGILINGYCKNKRIDDGLILFKTMLHKGLKPTTFNYNVILDGLFLAGRTVAAKEKFNEMVESGVSVCIDTCSIVLGGLCKNNCSSEAITLLRKLSTMNVKFDITIVNIIIGAFYRVKRNQEAKDLFAAIPANGLVPNAVTYTIMMTNLIKEGSVEEADNLFLSMEKSGSTANSWMLNHIIRRLLERGEIVKAGNYMSKVDVKSYSLEAKTVSLLISLFSREGKYRDHIKLLPTKYQFLEEAATVE

SEQ ID NO: 406 - protein, 363 aa, Triticum aestivum
MVDMGVRPNAIVYHSLIRGFCTHGDLVKAKELVTEMRNKAMRPPHIKFFHSIMQNLCTEGRVIEARDILDLMLHIGMRPDVPIFNLLIGGYCLVREMEDATKMFDDMVSYGLEPCNNTYGILINGYCKNRRIDDGLILFKEMLRKGLKPTTFNYNVILDGLFLAGRTVAAKVKFNEMVESGVSVCIDTYSIVLGGLCRNNCTGEAITLSKKLSTMNVKFNIAIVNILIGAFFRVRRNQEAKDLFAAIPANGLVPNAVTYTIMMTNLIKEGSVEEADTLFLSMEKSGCTANSCMLNHIIRRLLERGEIVKAGNYMSKVDAKSYSLEAKTVSLLISLLSGKGKYREHIKLLPMKYQFLEEAATVE

SEQ ID NO: 407 - protein, 759 aa, Triticum aestivum
MNIRTTRLHYIPTRLAPEFTAYSPRPMPGFSYAASMSPLRLRLHARHSASASQPSRSQGWDPHAALAVATVALFSRISQGALRRVAHPTACTYSILMDCCCRAHRPDMALAFFGRLLRTGLEADQVVFSTLLKGLCHAKRSDEALDVLLHRMPELGCTTHVVAYNTVIHGFFREGQVGKACDIFHGMAQQGVAPNVVTYNSVIDALCKARAMDKAEYFLGQMVDSGVVPNNVTYNSLIHGYSSSGHSKEAVRVLKQMTSKGIIPDVFTCNLLMASLCNNRRSKEAAELFDSMAMKGLKPNTVSYAILLHRYATEGCLVDMINLFNSMATDCILPNCRIFNILINAYAKSGKLDKAMLIFKEMHKRGVSPDVVTYSTVIHAFCKMGSLDIAMDKFNQMVDMGVRPNATVYHSLIQGFCTHGDLVKAKELVTEMRNKAMRPPDIKFFHSIMQNLCTEGRVIEARDILDLMLHIGMRPDVPIFNLLIGGYCLVREMEDATKMFDDMVSYGLEPCNNTYGILINGYCKNRRIDDGLILFKEMLRKGLKPTTFNYNVILDGLFLAGRTVAAKVKFNEMVESGVSVCIDTYSIVLGGLCRNNCTGEAITLSKKLSTMNVKFNIAIVNILIGAFFRVRRNQEAKDLFAAIPANGLVPNAVTYTIMMTNLIKEGSVEEADNLFLSMEKSGCSANSYMLNHIIRRLLEKGEMVKAGNYMSKVDAKSYSLEAKTVSLLISLFSRKGKYREHIKLLPTKYQFLEEAATVE

SEQ ID NO: 408 - protein, 363 aa, Triticum aestivum; identical to SEQ ID NO: 406

SEQ ID NO: 409 - protein, 759 aa, Triticum aestivum
MNIRTTRLHYIPTRLAPEFTAYSPRPMPGFSYAASMSPLRLRLHARHSASASQPSRSQGWDPHAALAVATVALFSRISQGALRRVAHPTACTYSILMDCCCRAHRPDMALAFFGRLLRTGLEADQVVFSTLLKGLCHAKRSDEALDVLLHRMPELGCTTHVVAYNTVIHGFFREGQVGKACDIFHGMAQQGVAPNVVTYNSVIDALCKARAMDKAEYFLGQMVDSGVVPNNVTYNSLIHGYSSSGHSKEAVRVLKQMTSKGIIPDVFTCNLLMASLCNNRRSKEAAELFDSMAMKGLKPNTVSYAILLHGYATEGCLVDMINLFNSMATDCILPNCRIFNILINAYAKSGKLDKAMLIFKEMHKRGVSPDVVTYSTVIHAFCKMGSLDIAMDKFNQMVDMGVRPNATVYHSLIQGFCTHGDLVKAKELVTEMRNKAMRPPDIKFFHSIMQNLCTEGRVIEARDILDLMLHIGMRPDVPIFNLLIGGYCLVREMEDATKMFDDMVSYGLEPCNNTYGILINGYCKNRRIDDGLILFKEMLRKGLKPTTFNYNVILDGLFLAGRTVAAKVKFNEMVESGVSVCIDTYSIVLGGLCRNNCTGEAITLSKKLSTMNVKFNIAIVNILIGAFFRVRRNQEAKDLFAAIPANGLVPNAVTYTIMMTNLIKEGSVEEADNLFLSMEKSGCSANSYMLNHIIRRLLEKGEMVKAGNYMSKVDAKSYSLEAKTVSLLISLFSRKGKYREHIKLLPTKYQFLEEAATVE

SEQ ID NO: 410 - protein, 569 aa, Triticum aestivum
MINLGVQPDAVTYSSFINALSKSGVMDKAEVVLRQMVDQGIVPNIITYTSLIHGYSTSGQWKAAVRIFKEMTSTGVRPNSVTLNSFIDSLCKHRKTKEARDIFDSMAANGHKPDIFSYSTLLNGYVKEGCFDDMTDLFNSMVWNGIVPNHHVFNILINAYAKRGLMDKAMHMFEVMRQQGVNPDVFSYQIVMDSLCKMGRMDAALDKFNQMVNQGVSPNKAVYQCLVLGSCSHGHFVKAKELISEAINRGLYSNSVFFYRVINDLCKEGKVNEAQDMFDFILGIGQRPDVIMYTSLMDGYCLVGEVEKALSVLDAMKSAGLQPDDVVYGTLLNGYCKIGRIADGLSLFREMSLSVVKPTTIIYNIILDGLFCSGRTVCAKEKFDMMIESGIPVGVDTYNIVLHGLCRNNCTDEAIELFKKLRAMNVKINVITLNTMISALFKTRRIEEAKDLFATISAIGLVPSVVTYSVMMTNFIKEGLLADADDMFSAMEKAGCAPNSRLLNQVVRVFLKNGEVVKAVTYLAKLDAKQLSLEASTVSLIVSLFSRKGKLRKHVKLLPVKYQPPEMLD

SEQ ID NO: 411 - protein, 772 aa, Triticum aestivum
MPTARLCSISASSFKASSGKPRAPVAALAAATERVRAGTLNQEDAHHLFDELLSQAAAFPVGGLNNFLATLARARPSAACSNGPALAVALFNRMSRGPGARVVSPTCCTYSILMDCCCRAGRPDLVLAFFCRLLRLGLSLNVTSFNNLLKGLCQSKRTNEALDVLLQRTPELDCAPDVVSYNIVINGCLKQGEVEKACNLYREMINLGVQPDAVTYSSFINTLSKSGAMDKAEVVLRQMVDQGIVPNIITYTSLIHGYSTSGQWKAAVRIFKEMTSTGVRPNSVTLNSFIDSLCKHRKTKEARDIFDSMAANGHKPDIFSYSTLLNGYVKEGCFDDMTDLFNSMVQNGIVPNHHVFNILINAYAKRGLMDKAMHMFEVMRQQGVNPDVFSYQIVMDSLCKMGRMDAALDKFNQMVNQGVSPNKAVYQCLVLGSCSHGHFVKAKELISEAINRGLYSNSVFFYRVINDLCKEGKVNEAQDMFDFILGIGQRPDVIMYTSLMDGYCLVGEVEKALSVLDAMKSAGLQPDDVVYGTLLNGYCKIGRIADGLSLFREMSLSVVKPATIIYNIILDGLFCSGRTVCAKEKFDMMIESGIPVGVDTYNIVLHGLCRNNCTDEAIELFKKLRAMNVKINVITLNTMISALFKTRRIEEAKDLFATISAIGLVPSVVTYSVMMTNFIKEGLLADADDMFSAMEKAGCAPNSRLLNQVVRVFLKNGEVVKAVTYLAKLDAKQLSLEASTVSLIVSLFSRKGKLRKHVKLLPVKYQPPEMLD

SEQ ID NO: 412 - protein, 772 aa, Triticum aestivum; identical to SEQ ID NO: 411

SEQ ID NO: 413 - protein, 772 aa, Triticum aestivum
MPTARLCSISASSFKASSGKPRAPVAALAAATERVRAGTLNQEGAHHLFDELLSQAAAFPVGGLNNFLATLARARPSAACSNGPALAVALFNCMSRGPGARVVSPTCCTYSILMDCCCRAGRPDLVLAFFCRLLRLGLSLNVTSFNNLLKGLCQSKRTNEALDVLLQRTPELDCAPDVVSYNIVINGCLKQGEVEKACNLYREMINLGVQPDAVTYSSFINALSKSGAMDKAEVVLRQMVDQGIVPNIITYTSLIHGYSTSGEWKAAVRIFKEMTSAGVRPNSVTLNSFIDSLCKHIKTKEARDIFDSMAANGHKPDIFSYSTLLNGYVKEGCFDDMTDLFNSMVRNGIVPNHHVFNILINAYAKRGLMDKAMHMFEVMRQQGVNPDVFSYQIVMDSLCKMGRMDAALDKFNQMVNQGVSPNKAVYQCLVLGSCSHGHFVKAKELISEAINRGLYSNSVFFYRVINDLCKEGKVNEAQDMFDFILGIGQRPDVIMYTSLMDGYCLVGEVEKALSVLDAMKSAGLQPDDVVYGTLLNGYCKIGRIADGLSLFREMSLSVVKPTTIIYNIILDGLFCSGRTVCAKEKFDMMIESGIPVGVDTYNIVLHGLCRNNCTDEAIELFKKLRAMNVKINVITLNTMISALFKTRRIEEAKDLFATISAIGLVPSVVTYSVMMTNFIKEGLLADADDMFSAMEKAGCAPNSRLLNQVVRVFLKNGEVVKAVTYLAKLDAKQLSLEASTVSLIVSLFSRKGKLRKHVKLLPVKYQPPEMLD

SEQ ID NO: 414 - protein, 772 aa, Triticum aestivum; identical to SEQ ID NO: 413

SEQ ID NO: 415 - protein, 753 aa, Triticum aestivum
  misc_feature (207)..(207): Xaa can be any naturally occurring amino acid
MPRFSSTTSMSSLRLRLHARHSSSASQPSHSQGWDPHAAFAAATERARSGKLTPKDAHHLFDELLRQANPVQERPLNNLLSALARAPASAACRNGPALAVNLFVRISQGARRRVAHPTACTYGILMDCCCRAHRLDLAFAFFGRLLRTGLKAGVIQVCTLLKGLCRAKRADEALDVLLHRMPELGCTPDVVAYTTVIHGFFKEGQVXKACNLFHEMALQGVTPDVVTYNSVIDALCKARAMDKAEYFLRQMIGNGVVPNNVTYNSLIHGYSSSGHWKEAVRVLKEMTSQGIIPDIVSYRILLHGYATEGCLVDMINLFNSMARYCILPDCHIFNILINAYAKSGKLDKAMLIFKEMQKQGVSPNAVTYSTVIDAFCKKGQLDDAMIKFNQMIDTGVPQGTAVYGSLIQGFCTHGNLVKAKELLTEMMNKGIPPPDIKFFHSIMQNLCTEGRVIEARDVLGLIAHIGMRPNVCTFNILIGGYCLVGKMEDASKIFDDMMSYGLEPSNITYAILINGYCKNERINDGLILFKEMLRKGLKPTTFNYNVILDGLFLAGRTVAAKEKFDEMVEFGVSVRIDTYSIVLGGLCRNNCNGEAITLFQKLSTMDVKFNITIVNIMIDAFYRVQRNQEAKDLFAAVSANGLVANVFTYTIMMKNLIKEGSVEEADDLFLSMEKSGCTADSYMLNLIVRMLLEKGELVKAGNYMSKVDAKSYSLEAETVSLLISLFSGKGKYREHIGLLPTKYQFREEAATVE

SEQ ID NO: 416 - protein, 753 aa, Triticum aestivum
MPRFSSTTSMSSLRLRLHARHSSSASQPSHSQGWDPHAAFAAATERARSGKLTPKDAHHLFDELLRQANPVQERPLNNLLSDLARAPASAACRNGPALAVNLFVRISQGARRRVAHPTACTYGILMDCCCRAHRLDLAFAFFGRLLRTGLKAGVIQVCTLLKGLCRAKRADEALDVLLHRMPELGCTPDVVAYTTVIHGFFKEGQVGKACNLFHEMALQGVTPDVVTYNSVIDALCKARAMDKAEYFLRQMIGNGVVPNNVTYNSLIHGYSSSGHWKEAVRVLKEMTSQGIIPDIVSYRILLHGYATEGCLVDMINLFNSMARYCILPDCHIFNILINAYAKSGKLDKAMLIFKEMQKQGVSPNAVTYSTVIDAFCKKGQLDDAMIKFNQMIDTGVPQGTAVYGSLIQGFCTHGNLVKAKELLTEMMNKGIPPPDIKFFHSIMQNLCTEGRVIEARDVLGLIAHIGMRPNVCTFNILIGGYCLVGKMEDASKIFDDMMSYGLEPSNITYGILINGYCKNERINDGLILFKEMLRKGLKPTTFNYNVILDGLFLAGRTVAAKEKFNEMVEFGVSVRIDTYSIVLGGLCRNNCSDEAITLFQKLSTMDVKFNITIVNIMIDAFYRVQRNQEAKDLFAAVSANGLVADVFTYTIMMKNLIKEGSVEEADDLFLSMEKSGCTADSYMLNLIVRMLLEKGELVKAGNYMSKVDAKSYSLEAETVSLLISLFSGKGKYREHIGLLPTKYKFREEAATVE

SEQ ID NO: 417 - protein, 330 aa, Triticum aestivum
MPAARLSSISTSSFRAPSRAPLAALAAATERVRAGTLSQEDAHHLFDQLLGQAAAVPERGLNNFLAALARAPPSAACRDGPGLAIALFNRMSRGAGARVASPTLCTYSILMDCCCRAGRPDLVLAFFGRLLRLGLRLDIISSSNLLKGLCQAKRSNEALDMLLHRMPELDCVPDVFSYSIVINGCFKQGEVDKACNLFHQMPQLGVQPNVVIYNSVIDALSKSGAMDKAEVVLRQMVDQGIEPNIKTYNCLIHGYSTFGQWKEALRVFKEMASLGVVPDVVTLTSLIDSLCKHRRTKEAREIFDSMAAKGLPGSGFLLSWSFCESQGFDL

SEQ ID NO: 418 - protein, 330 aa, Triticum aestivum; identical to SEQ ID NO: 417

SEQ ID NO: 419 - protein, 330 aa, Triticum aestivum
MPAARLSSISTSSFRAPSRAPLAALAAATERVRAGTLSQEDAHHLFDQLLGQAAAVPERGLNNFLAALARAPPSAACRDGPGLAIALFNRMSRGAGARVASPTLCTYSILMDCCCRAGRPDLVLAFFGRLLRLGLRLDIISSSNLLKGLCQAKRSNEALDMLLHRMPELDCVPDVFSHSIVINGCFKQGEVDKACNLFHQMPQLGVQPNVVIYNSVIDALSKSGAMDKAEVVLRQMVDQGIEPNIKTYNCLIHGYSTFGQWKEALRVFKEMASLGVVPDVVTLTSLIDSLCKHRRTKEAREIFDSMAAKGLPGSGFLLSWSFCESQGIDL

SEQ ID NO: 420 - protein, 779 aa, Triticum aestivum
MFINFANFYQIHELFRQIHKKIQIDGKKFNFANFFQIVNFLLNSWTFFFLQVHGIDAPAARALVATWWQKFAGLQLTREENVMHPSDPIFGAPWGSRNSIDKSAAHLMGVSITRKDSSENHQVPLYPKHTPPPPPDSSAAYEAAHRRASPPVPPPAFTSSAAALVAARAPSVAGDTNRSRCASSADARTSRVELGWNRPEMPAARLSSISTSSFRAPSRAPLAALAAATERVRAGTLSQEDAHHLFDQLLGQAAAVPERGLNNFLAALARAPPSAACRDGPGLAIALFNRMSRGAGARVASPTLCTYSILMDCCCRVGRPDLVLAFFGRLLRLGLRLDIISSSNLLKGLCQAKRSNEALDMLLHRMPELDCVPDVFSYSIVINGCFKQGEVDKACNLFHQMPQLGVQPNVVIYNSVIDALSKSGAMDKAEVVLRQMVDQGIEPNIKTYNCLIHGYSTFGQWKEALRVFKEMASLGVVPDVVTLTSLIDSLCKHRRTKEAREIFDSMAAKGLKPNIVSYSTMLNGYVKEGSFEDMTDLFNSMVRNGVVPNHHIFNILINAYAKRGLMDEAMHMFEVMRQQGVNPDVVDYLVIMDSLCKMGRMDAAVDKFNQMVNQGVSPNKAVYQCLVLGSCSHGHFVKAKDLISEAINRGLFSNSVFFYPVINDLCKEGKVNEAQDMFDFILGIGRRPDVIMYNSLMDGYCLVGKVEEALRVLDAMKSAGLQPTAVTYAILLNGYCKIGRIADGLSLFREMSLSGVKPTTFINNNNNNKAFSPKQVGVG

SEQ ID NO: 421 - protein, 765 aa, Triticum aestivum
MPTARLSSISTSSFRAPLAALAAATERVLAGTLSREDAHHLFDELLGQAAAAPEHGLNNFLAALARAPPSAACSDGPGLAIALFNRMSRGAGARVVSPTLCTYSILMDCCCRARRPELVVAFFGRLLRLGLRLDIISSSNLLKGLCQAKRSNEALDMLLHRMPELDCAPDVFSFNIVINGCFKEGEVDKACNLFHEMPQLGVQPDVVTYTSIINALSKSGAMDKAEVVLRQMVDQGIGPNIRTYTSLIHGYSASGQWKAAARVFKEMVSLGVLPNVVTWNSFMDSLCKHRRTKEARDIFDSMAAKGQKPDIVSYSIMLNGYAKEGYFDDMTDLFNSMLQNGIVPNHHVFNILINAYAKRGLMDEAMHMFEVMRQQGVNPNVVSYQVIMDSLCKMGRMDAALEKFNQMVNQGVSADKAVYRCLVLGSCSHGDFVKAKELISEAVNRGLCSNSVFFYSVINDLCKEGKVKEAQDMFHFIVGIGQRPDVIMYTSLMDGYCLVGKVEEALRVLDAMKSAGLQPTAVTYAILLNGYCKIGRIADGLSLFKEMSLSGVKPTTIMYNIILDGLFRSGRTVSAKEKFCTMSESGIPVGIDTYNIVLSGLCKNNCTGEAIELFKKLRAMNVKIDVITLNIMISAMFKTRRIEEAKDLFATISAIGLVPSVVTYSLMMTNFIKEGLLAEADDMFLAVEKANCAPNSRLLNHVVRVLLEKGAVVKGANYLAKLDAKQMSLDVSTISLIVSLFSGEGKLREHVKLLPVKYQPPENSG

SEQ ID NO: 422 - protein, 765 aa, Triticum aestivum
MPTARLSSISTSSFRAPLAALAAATERVRAGTLSREDAHHLFDELLGQAAAAPEHGLNNFLAALARAPPSSACSDGPGLAIALFNRMSRGAGARVVSPTLCTYSILMDCCCRARRPELVVAFFGRLLRLGLRLDIISSSNLLKGLCQAKRSNEALDMLLHRMPELDCAPDVFSFNIVINGCFKEGEADKACNLFHEMPQLGVQPDVVTYTSIINALSKSGAMDKAEVVLRQMVDQGIGPNIRTYTSLIHGYSASGQWKAAARVFKEMVSLGVLPNVVTWNSFMDSLCKHRRTKEARDIFDSMAAKGQKPDIVSYSIMLNGYAKEGYFDDMTDLFNSMLQNGIVPNHHVFNILINAYAKRGLMDEAMHMFKVMRQQGVNPNVVSYQVIMDSLCKMGRMDAALDKFNQMVNQGVSPDKAVYRCLVLGSCSHGDFVKAKELISEAVNRGLCSNSVFFYSVINDLCKEGKVKEAQDMFHFIVGIGQRPDVIMYTSLMDGYCLVGKVEEALRVLDAMKSAGLQPTAVTYAILLNGYCKIGRIADGLSLFKEMSLSGVKSTTIMYNIILDGLFRSGRTVSAKEKFCTMSESGIPVGIDTHNIVLSGLCKNNCTGEAIELFKKLRAMNVKIDVITLNIMISAMFKTRRIEEAKDLFATISAIGLVPSVVTYSLMMTNFIKEGLLAEADDMFLAVEKANCAPNSRLLNHVVRVLLEKGAVVKGANYLAKLDAKQMSLDVSTISLIASLFSGEGKLREHVKLLPVKYQPPENSG

SEQ ID NO: 423 - protein, 571 aa, Triticum aestivum
MPQLGVQPDVVTYNSIIDALSKSGAMDKAEVLLRQMVDQGIEPNIRTYSCLIHGYSTFGQWKEALRVFKEMASLGVAPDVVTLSSLIDSLCKHRRTKQAREIFDSMAAKGLKPDIVSYSTMLNGYVKEGSFEDMTDLFNSMVRNGIVPNHHVFNILINAYARRGLMDEAMHMFEVMRQQGVNPDVVSYLVVMDSLCKMGRMDAALDKFNQMVNQGVSPNKAVYQCLVLGSFSHGDFVKAKELISEAVNRGMCSNSVFFYPVINDLCKEGKVKEAQDMFDFILGIGQRPDVIMYTSLMDGYCLVGKVEKALSVLDAMKSAGLQPDDVVYATLLNGYCKIGRIADGLSLFREMSLSGVKPTTIIYNIILDGLFCSGRTGFAKEKFHTMTESGIPVGVDTYNIVLSGLCRNNCTDEAIELFKKLRATNVKIDVMTLNIMISAMFKTRRIEEAKDLFATISAIGLVPSVVTYSLMMTNFIKEGLLADADDTFLVMEKAGCAPNSSLLNQVVRVLLEKGAVVKAATYLAKLDAKQLSVEASTISLIVSLFSGEGKLREHVELLPVKYQPPQSSADN

SEQ ID NO: 424 - protein, 715 aa, Triticum aestivum
MSRRVVPVGRRILEQNIKGRYRTGHIGTVDALHLFDELLQVAQPSSIAAINCLLTVFGRDCPALGVSLFNRVARTKVPLQSVTYGILVNCCCGAGRLDLGFAAMGNIIKMGFMKESVVAFSHLLKAICAENKTSYAMDIVLRVMPELNCTPNIFSYSILFKGLCNDKRSQEALDLIHIMVEHGGSCQPNVVSYSTVIDGLLKEGEVNKAYSLFCEMLQRGISPDVVTCSSIISGMCKLHAMDKAEDVLQQMLDRGILPDVATYTSLMHGYYSLGQCEEVDRIFKEMSRNGVQPDIVTYNIQMDYLCKSGRCAEARKIFDSMVSLGQKPDVTTYNVLLHGYAMERSFHDMNCLIELMDDNGISPDHYGYNILISAYAKEKMVDEVMHIFTKMRQQGLNPDVANYGAAVNLLSKIGRMDDAMSQFNQMITEGLAPDIIVFTPLISGFCSCGKWEKVDELFSEMLDRGICPNTVFFNTIMDRLCKNGRVMEAQDLFDLMVHMGVKPDVCTYNTLIGGYLFVGKMDEVSKLLDNMVSIGMEPDVITYNILIDGYSKNGRIDDALVVFREMLDRKVKPCVITFNSMIGALLKCGRKAEAKDLFDGIWANGLVPDVITYSLMIQKLIEEGSLQESDDLFLSMEKNGCAADSRMLNSMVRSLLQKGEVPRAGTYLSKIDERRFTFEASTASLLAALASGGKSQEYKELLPEKYHYFLEQGTD

SEQ ID NO: 425 - protein, 715 aa, Triticum aestivum; identical to SEQ ID NO: 424

SEQ ID NO: 426 - protein, 715 aa, Triticum aestivum; identical to SEQ ID NO: 424

SEQ ID NO: 427 - protein, 741 aa, Triticum aestivum
MPRFSSTTPMSPPRLLLRLGARHSSSTSHPSRIWDPHAAFAAATQRARSGTLTTEDAHHLFDELLRQGNPVQERPLTNFLAALARAPASAFCSDGPALAVALFGRLSRGAGRRVAQPNVFTYGVLMDCCCRARRLDLAIAFFARLLKTGLEANQVIFCTLLKGLCHAKRSDEALDVVLHRMPELGCTPNVVAYTTVIHGFLKEGQVGKACNLFHGMAQQGVAPDVVTYNSVIDALCKARAMDKAEYFLCEMVDNGVVPNNVTYNSLIHGYSSLGHQKEAVRVLKEMTRQGIIPDVITCTSLMTFLCKNGKSKEAAEIFDSMPTKGLKHDAVSYAILLHGYATEGCLVDMINLFNSMDRDCILPNCHIFNILIYAYAKSGKLDKAMLIFRDMQKQGVSPDAVTYSTVIHAFCKKGRLDDAVIKFNQMIDTGVRPEASAYRSLIQGFCTHGDLVKAKEYVTEMMKKGMLPPDIMFFSSIMQKLCTEGRVIEARDILDLIVRIGMRPNVFIFNILIGGYCLVCKMEDATKMFEDMVSFGLEPCNITYGILINGYCKNRRIDDGLILFQEMLHKGLKPTTFNYNVILDGLFLAGRTVAAKEKFDEMVESGVSVCSDTYSIVLAGLCRNNCSSEVIMLFQKLRAMNMKFNIRIVTIMIDAFYKVRRNQEAKDLFAAIPSNGLVANVVTYSIMMKSLIKEGSVEEADTLFIDGEERLYCKLLDVKSYYQKVTGKRRDSQGWKLYVES

SEQ ID NO: 428 - protein, 741 aa, Triticum aestivum; identical to SEQ ID NO: 427

SEQ ID NO: 429 - protein, 741 aa, Triticum aestivum
MPRFSTTTPMSPPRLLLRLGARHSSSTSHPSRIWDPHAAFAAATQRARSGTLTTEDAHHLFDELLRQGNPVQERPLTNFLAALARAPASAFCSDGPALAVALFGRLSRGAGRRVAQPNVFTYGVLMDCCCRARRLDLAIAFFARLLKTGLEANQVIFCTLLKGLCHAKRSDEALDVVLHRMPELGCTPNVVAYTTVIHGFLKEGQVGKACNLFHGMAQQGVAPDVVTYNSVIDALCKARAMDKAEYFLCEMVDNGVVPNNVTYNSLIHGYSSLGHQKEAVRVLKEMTRQGIIPDVITCTSLMTFLCKNGKSKEAAEIFDSMPTKGLKHDAVSYAILLHGYATEGCLVDMINLFNSMDRDCILPNCHIFNILIYAYAKSGKLDKAMLIFRDMQKQGVSPDAVTYSTVIHAFCKKGRLDDAVIKFNQMIDTGVRPEASAYRSLIQGFCTHGDLVKAKEYVTEMMKKGMLPPDIMFFSSIMQKLCTEGRVIEARDILDLIVRIGMRPNVFIFNILIGGYCLVCKMEDATKMFEDMVSFGLEPCNITYGILINGYCKNRRIDDGLILFQEMLHKGLKPTTFNYNVILDGLFLAGRTVAAKEKFDEMVESGVSVCSDTYSIVLAGLCRNNCSSEVIMLFQKLRAMNMKFNIRIVTIMIDAFYKVRRNQEAKDLFAAIPSNGLVANVVTYSIMMKSLIKEGSVEEADTLFIDGEERLYCKLLDVKSYYQKVTGKRRDSQGWKLYVES

SEQ ID NO: 430 - protein, 741 aa, Triticum aestivum; identical to SEQ ID NO: 429

SEQ ID NO: 431 - protein, 310 aa, Triticum aestivum
MPELGCTPDVVAYSTVIHGFFKEGQVGKACNLFHGMAQQGVAPDVVTYNSVIDALCKARAMDKAEYFLGQMVDSGVVPNNVTYNSLIHGYSSSGHSKEAVRVLKDMTSKGIIPDVFTCNSLMASLCKNGRSKEAAEIFNSMSMKGLKPNTISYAILLHGYATEGCLVDMINLFNSMATDCILPNCHIFNILINAYAKYGKLDKAMLIFKDMQKQGVSPDAVTYSTVIHAFCKKGRLDDAVIKFNQMIDTGVLLEASVYRSLIQGFCTHGDLVKATEYVTEMMKKGMLPPDIMFFSSIMQNLCTEGRVIEA

SEQ ID NO: 432 - protein, 715 aa, Triticum aestivum
MSRRLVPVGRRILEQNIKAWYHAGDIGTKDALHRFDELLQDAGSSSIRAVNYLLTVVGRDCPALGVSLFNRVARAKVAPNSITYTILVDCCCRAGRLDLGFAAMGHIIKMGFTADAIFSFSHLLKSICAEKKTSYAMDIVLRVMPELNCTPDIFSYSILFKGLCNEKRSQEALELIHIMVEDGGCCRPDVVSYSTVIDGLLKEGEVDKAYGLFCEMLQRGISPDDVTYNSIISGMCKVHAMDKAEEVLQQMFDRGILPDVATYNSLIHGYYSLGRCKEVDRIFKEMSRNGVQPDIVTYNIQMDYLCKNGRCTEARKIFDSIVSLGQKPTVTTYSILLHGYALERSFHEMHCLIDLMVGNGIAPDHFVYNILISAYAKEEMIGEVMHIFKKMRQHGLNPDVANYGAVVNLLSKIGRMDDAMSQFNQMITEGLAPDIIIFTPLISGFCSCGKWEKVHELFSEMLDRGICPNTVFFNTIMDRLCKNGRVMEAQDLFDLMVHMGVKPDVCTYNKLTGGYLFIGKMDEVSKLLDNMVSIGMEPDVITYNILIDGYSKNGKINDALVFFREMLEGKVKPSVIIFNIMIGVLLKCGRKEEAKDLFDGIWAKGLVPDVVTYSLMIQKLIEEGSLQESNDLFLSMEKNGCAADSRMLNAIVRSLLQKGEVPRAGTYLSKIDERRFTLEASTASLLTALVSGGKGQEYKELLPEKYHSFLEQGTD

SEQ ID NO: 433 - protein, 715 aa, Triticum aestivum; identical to SEQ ID NO: 432

SEQ ID NO: 434 - protein, 715 aa, Triticum aestivum; identical to SEQ ID NO: 432

SEQ ID NO: 435 - protein, 715 aa, Triticum aestivum; identical to SEQ ID NO: 432

SEQ ID NO: 436 - protein, 715 aa, Triticum aestivum; identical to SEQ ID NO: 432

SEQ ID NO: 437 - protein, 715 aa, Triticum aestivum; identical to SEQ ID NO: 432

SEQ ID NO: 438 - protein, 733 aa, Triticum aestivum
MRRRLVTVGRRILEQKIQDRHRAGDIGRRILEQNIKARYHAGDIGTEDALNLFDELIQVAQPSSIRAINCLLTVVGRDCPALGVSLFNRVARAKVPPHNITYGILVDCCCRAGRLDLGHAAMGHVIKLGFTAEAIINFSHLLKAICAVKKTSYAMDIVLRVMPEFNCTPNIFSYSILFKGLCNERRSQEALELINIMVEDGGSCQPDVVTYNTVIDGLLKEGEVDQAYSLFSEMLRQGVSPNVVTCNSIISGMCKLHAMDKAEEVLQQMLDRRILPDVATYNSLIHGYYSLGQCEEVDRIFKEMTTNGVQPDIVTYNIQMDYLCKNGRCAEARKIFDSMISLGQKPTVTTYNILLHGYAMERSFHDMNCLIELMDDNGISPDHYGYNILISAYAKEKMVDDVLHIFTKMRQQGLNPDVANYGAVINLLSSIGRMDDAMSQYNQMINEGLAPDIIVFNSLISGFYSCGKWEKVHELFSEMLDRGICPNTVFLNTIMDRLCKNERVMEAQDLFDLMVHMGVKPDVWTYNTLIGGYLFVGKMDEVRKLLDNMCSIGMEPDVVTYSILIDGYSKNGRIDDAFVVFKELLGGKVKPCVITFTIMIGALLKCGRKEEAKDLFDGIWANGLVPNVITYSLMIQNLIEEGSLQESDDLFLSMEKNGCAADSRMLNAIVRRLLQRGEMPRAGTYLSKIDEGSFTLEASTAGLLTALASGGKCQEYKGLLPEKYHSFLEQGTG

SEQ ID NO: 439 - protein, 733 aa, Triticum aestivum; identical to SEQ ID NO: 438

SEQ ID NO: 440 - protein, 715 aa, Triticum aestivum
MRRRLVPVGSRLSERNIEHRYRSRNIGTEDALNLFDELIQVAGPSSVRAINCLLTVVGRDCPAIGVSLFNRVARAKVPPHNITYGILVDCCCRAGRLDLGHAGMGHVIKLGFAAEAIVNFSHLLKAICAEKKTSYAMDIVLRIMPEFNCIPNIFSYSILLKGLCNEKRSQEALELIHMMIDHGGSCQPNVVSYSTVLDGLLKEGEVGKAYSLFCVMLQRGISPNAVTCTSIISGMCKVHAMDKAEEVLQQMTNRGILPNSATYNSLIHGYYSLGWCKEVDRILKEMSKNGVQPDIITSNIQLDYLCKSRRCAEARKIFDSMVSLGQKPDVTTYSILLHGYAMEKSFHDMLCLIDLMVGNGIAPNHYVYNILISAYAKEEMVDEVMHIFTKMRQKGLNPDAVSYGTVIDLLSRIGRMDDAMSQFAQIITEGLAPDIIVFNSLISGFCSCGKWEKVHELFSEMLDHGICPDRVFFNTVMDHLCKNGRVMEAQDVFDLMVHMGVKPFVRDYNTLIHGYCLVGKMDEGRKLLDNMFSIGLKPDDFTYSILIDGYSKKGRIDDALIIVREMLDGKVKPSIITFNIMIGALLKGGRKEEAKDLFDGIWAKGLVPDVVTYSLMIQKLIEEGSLQESDDLFISMEKNGCAADSQMLNAIVRSLLQKGEVPRAGTYLSKIDERRFTPEASTASLLTALVSEGKGQEYKELLPEKYHSFLEQGTD

SEQ ID NO: 441 - protein, 714 aa, Triticum aestivum
MRRRLVPVGSRLLERNIEHRYRSRNIGTEDALNLFDELIQVAGPSSVRAINYLTVVGRDCPAIGVSLFNRVARAKVPPHNITYGILVDCCCRAGRLDLGHAGMGHVIKLGFAAEAIVNFSHLLKAICAEKKTSYAMDIVLRIMPEFNCIPNIFSYSILLKGLCNEKRSQEALELIHMMIDHGGSCQPNVVSYSTVLDGLLKEGEVGKAYSLFCVMLQRGISPNAVTCTSIISGMCKVHVMDKAEEVLQQMTDRGILPNSATYNSLIHGYYSLGWCKEVDRILKEMSRNGVQPNVVTYNIQLDYLCKSRRCAEARKIFDSMVSLGQKPDVTTYSILLHGYAMEKSFHDMLCLIDLMVGNGIAPNHYVYNILISAYAKEEMVDEVMHIFTKMRQKGLNPDAVSYGTVIDLLSRIGRMDDAMSQFAQIITEGLAPDIIVFNSLISGFCSCGKWEKVHELFSEMLDRGICPDRVFFNTVMDHLCKNGRVMEAQDVFDLMVHMGVKPFVRDYNTLIHGYCLVGKMDEGRKLLDNMFSIGLKPDDFTYSILIDGYSKKGRIDDALIIVREMLDGKVKPSIITFNIMIGALLKGGRKEEAKDLFDGIWAKGLVPDVVTYSLMIQKLIEEGSLQESDDLFISMEKNGCAADSQMLNAIVRSLLQKGEVPRAGTYLSKIDERRFTPEASTASLLTALVSEGKGQEYKELLPEKYHSFLEQGTD

SEQ ID NO: 442 - protein, 714 aa, Triticum aestivum; identical to SEQ ID NO: 441

SEQ ID NO: 443 - protein, 715 aa, Triticum aestivum
MRRRLVPVGSRLLERNIEHRYRSRNIGTEDALNLFDELIQVAGPSSVRAINCLLTVVGRDCPAIGVSLFNRVARAKVPPHNITYGILVDCCCRAGRLDLGHAGMGHVIKLGFAAEAIVNFSHLLKAICAEKKTSYAMDIVLRIMPEFNCIPNIFSYSILLKGLCNEKRSQEALELIHMMIDHGGSCQPNVVSYSTVLDGLLKEGEVGKAYSLFCVMLQRGISPNAVTCTSIISGMWKVHAMDKAEEVLQQMTNRGILPNSATYNSLIHGYYSLGWCKEVDRILKEMSKNGVQPDIITYNIQLDYLCKSRRCAEARKIFYSMVSLGQKPDVTTYSILLHGYAMEKSFHDMLCLIDLMVGNGIAPNHYVYNILISAYAKEEMVDEVMHIFTKMRQKGLNPDAVSYGTVTDLLSRIGRMDDAMSQFAQIITEGLAPDIIVFNSLISGFCSCGKWEKVHELFSEMLDHGICPDRVFFNTVMDHLCKNGRVMEAQDVFDLMVHMGVKPFVRDYNTLIHGYCLVGKMDEGRKLLDNMFSIGLKPDDFTYSILIDGYSKKGRIDDALIIVREMLDGKVKPSIITFNIMIGALLKGGRKEEAKDLFDGIWAKGLVPDVVTYSLMIQKLIEEGSLQESDDLFISMEKNGCAADSQMLNAIVRSLLQKGEVPRAGTYLSKIDERRFTPEASTASLLTALVSEGKGQEYKELLPEKYHSFLEQGTD

SEQ ID NO: 444 - protein, 714 aa, Triticum aestivum; identical to SEQ ID NO: 441

SEQ ID NO: 445 - protein, 634 aa, Triticum aestivum
MPTARLSSVSASSFKASSRKPRAPLAALAAATERVRAGTLSQEDAHHLFDELLGQAAIVPERGLNNFLAALARAPPSGACGDGPTLAVTLFNRMSRGAGARVVSPTLCTYSILMDCCCRAGRPDLVVAFFGRLIRLGLRLEIISFSNLLKGLCQAKCSNEALDMLLHRMPELDCAPHVVSYNIVINGCFKQGEVEKACNLYREMINLGVQPNVVTYSSFINALSKSGAMDKAEVVLRQMVDQGIAPNIITYTSLIHGYSTSGQLKAAVSIFKEMASAGVRPNSVTLNSFIDSLCKHRKTKEARDIFDSMAAKGHKPDIFSYSTMLNGYAKEGCFDDMTDLFNSMVRNGIVPDHHVFNILINAYAKRGLMDKAMHMFEVMRQQGVNPNVVDYGILLNGYCKIGRIAHGLSLFREMSLSGVKPTTIMYNIILDGLFRSGRSVSAKEKFDMMLESGIPVNVRTYNIVLCGLCKNNCTGEAMELFKKLRAMNVQIDVMILNTMISAMFKTRRIEEAKDLFATISAIRLVPSVVTYSVMMTNFIKEGLLADADDMFLEMEKAGCAPNSSLLNQVVRALLEKGAVVKAATYLAKLDAKQLSVEASTILLIVSLFSGEGKLREHIELLPVKYQPPESSTDN

SEQ ID NO: 446 - protein, 729 aa, Triticum aestivum
MVPPSPSPSSTACAENKPARGWHLTVHTYGILMDCCCRASRPDLGLAFFGRLLRTGLKTNEIVASTFLKCLCYTKRTEEAGNLLLHRMPELCCVPDAFSYNIVLKSLCDNSMSQRGLDLLQMMAKEGGGCSPNVVAYSTVIHGFFKEGETGKACNLFHEMMQQGVVPNVWTYSSIIDALCKARAMDKAELALQQMVANGAQPNEVTYNCMIHGYSTSGRLKEAAKMFREMKSRGLTPNIVTCGSLMTSLCKHGRSKEAREIFDSMTAKGHRADVVSYSILLHGYANEGCFADMIDLFNSMESNGIAADCRVFTILIDAYAKRGMMDDAMHIFTEMQQQGVSPNVVTYSTVISALSRMGRLTDSMEKFNQMVALGVQPDRAIYRSLIQGFCMHGGLVKDKELVSQMINKGIPRPSIVFFNSVINSMCKEGRVMDAHDIFDLVIDIGERPDDITFNSLIDGYCLVGKMDKAFKILDAMESVGVQPNIVTYNTLLDGYFKNGRINDGLTLFREMPRKRIKPDTVTYGIMLDGLFRAGRTVAARTMFHEMIESGITVDIPTYNIVLRGLSRNNCTDEAIALFQKLGAMSVKFNISIFNTMIDAMYKVRRREEANDLFAAISASGLVPKESTYAVMIINLLKHGAVEEADNMFSSMEKTGIVPSSRLLNCIIRMLLEIGEIAKAGNYLSKLDGNSISLEASTTSLMLSLFSKKGKYHEDMKLLPAKYQFFDGCS

SEQ ID NO: 447 - protein, 716 aa, Triticum aestivum
MFSVFIFALVFYVHLAIALFNRMCREQSGPRVVPLTVHTYNILMDCCCRASRPDLGLAFFARLLRTGLKTNEITANTFLKCLCYARRTDEALNVLLHRMFELGCVPDAISYNIVLKSLCEDSMSQRALDLLQMMAKEGGGCSPNVVAYSTVIHGFFKEGETGKACNLFHEMMHQGVEPSVWTYSSIIDALCKARAMDKAELVLQQMVNKGVLPNNVTYNCMIHGYSTSGQWKEAAKLLREMKSRDLIPDIVTRNSFLASLCKHGRSKEAAEFLDSMTAKGHKPDIVSYRILFHGYASEGCFADMIDLFNSMESNGIAADCHVFNILISGYAKRGMTEEAMLIFTEMRGQGVSPDVVTYSIVIAALSRMGRLTDAIEKFNEMTALEVHPDTTVYHSLIQGCCIDGDLVKAKELMLEMMNGGILRPNIVFFNSVINSLCKEGRVMDAHDVLDLVIGIGERPDTITFSSLIDGYCLVGKTDKAFKILDAMESVGVEPDIVTYNTLLDGYFKNRRIDDALTLFREMPRKRIKPGTVTYGIMLDGLFRAGRTVAAKKMFHEMNGSGTTVDISTYAIILGGFCRNNCADEAITLFHKLGAMNVKFNIAIVNTMINAMYKVGRREEAKELFAGILARGLVPNESTYGVMIKNLLKDGAVEDANNVFSSMDKSGIVPSSRLINDIIRLLLEKGNEKNSALQNIARPFSKCYTSYSALIACYISK

SEQ ID NO: 448 - protein, 716 aa, Triticum aestivum
MFSVFIFALVFYVHLAIALFNRVCREQSGPRVVPLTVHTYNILMDCCCRASRPDLGLAFFARLLRTGLKTNEITANTFLKCLCYARRTDEALNVLLHRMSELGCVPDAISYNIVLKSLCEDSMSQRALDLLQMMAKEGGGCSPNVVAYSTVIHGFFKEGETGKACNLFHEMMHQGVEPSVWTYSSIIDALCKARAMDKAELVLQQMVNKGVLPNNVTYNCMIHGYSTSGQWKEAAKLLREMKSQDLIPDIVTRNSFLASLCKHGRSKEAAEFLDSMTAKGHKPDIVSYRILFHGYASEGCFADMIDLFNSMESNGIAADCHVFNILISGYAKRGMTEEAMLIFTEMRGQGVSPDVVTYSIVIAALSRMGRLTDAIEKFDEMTALEVHPDTTVYHSLIQGCCIDGDLVKAKELMLEMMNGGILRPTIVFFNSVINSLCKEGRVMDAHDVLDLVIGIGERPDTITFSSLIDGYCLVGKTDKAFKILDAMESVGVEPDIVTYNTLLDGYFKNRRIDDALTLFREMPRKRIKPGTVTYGIMLDGLFRAGRTVAAKKMFHEMNESGTTVDISTYAIILGGFCRNNCADEAITLFHKLGAMNVKFNIAIVNTMINAMYKVGRREEAKELFAGILARGLVPNESTYGVMIKNLLKDGAVEDANNVFSSMDKSGIVPSSRLINDIIKLLLEKGNEKNSALQNIARPFSKCYTSYSALIACYISK

SEQ ID NO: 449 - protein, 716 aa, Triticum aestivum; identical to SEQ ID NO: 447

SEQ ID NO: 450 - protein, 716 aa, Triticum aestivum; identical to SEQ ID NO: 447

SEQ ID NO: 451 - protein, 716 aa, Triticum aestivum; identical to SEQ ID NO: 448

SEQ ID NO: 452 - protein, 716 aa, Triticum aestivum; identical to SEQ ID NO: 447

SEQ ID NO: 453 - protein, 733 aa, Triticum aestivum
MSRLRHSTSTAPMFHLRLLRCRFSSIPISPPSRSWSPVTAFAAATERVSAGTLSPEDAHRLFDELLRQATPVPARSLNGLLTALSRAPDTGACRDGPALALALFNRTRREEAGSWVVPSTIFTYGILMNCCCRTRRPELGLAFFGRVLRMGLRTNVVVATTVLQCLCGAKRTDEAVDILLHRMSELGCVPDDFSYNIVLKSLCDDSRSQRALDLLRMWENERGVCSPNVYTYNTVIHGFFKEGEVSKACNLFHEMAQKGVPPNVVTYSLTIDALCKARAMDKAQLFLRQMIHKGVRPNNVTYNVMIHGYCTLGQWKEAGKMFREMTRQGLIPDIVTWTSFMASLCKHGRTKEAAEFFDSMTAKGHKPDLVMYHVLLHGYATEGCFADMINLFNSMATKGIVPDRQVFNILIDAHAKHGMMDEAMHIFTGMQGQGVCPDVGTYSTLISALCRMGRLADAMDNFSQMIGKGVQPNTVVYHSLIQGFSTHGDLRKAKELVYEMTNKGIPCPNIAFFSSIMDSLCKEGRVMDAHDIFHLVTDIGLKPNIITFNTLIDGHCLVGEMEKAFGVLDSMVSAGIEADVFTYNTLAYGYCRCGRIDDGLILFREMLQNKPKPTTITYNIILDGLFRAGRTFAAKKMFLEMIETGITVSISTYSIILGGLCRNNCSDEAITLFQKLGAMNVKFDIKILTTMINAMFKVWRREEANGLFAAISASGMVPNADRKSSKRRISGRS

SEQ ID NO: 454 - protein, 733 aa, Triticum aestivum; identical to SEQ ID NO: 453

SEQ ID NO: 455 - protein, 733 aa, Triticum aestivum; identical to SEQ ID NO: 453

SEQ ID NO: 456 - protein, 733 aa, Triticum aestivum; identical to SEQ ID NO: 453

SEQ ID NO: 457 - protein, 733 aa, Triticum aestivum; identical to SEQ ID NO: 453

SEQ ID NO: 458 - protein, 733 aa, Triticum aestivum; identical to SEQ ID NO: 453

SEQ ID NO: 459 - protein, 716 aa, Triticum aestivum
MSRRLVPVGRRILEQNIKDRYRTGHIGTEDALQLFDELLQVAQPSSIAAINCLLTVVGRDCPALGVSLFNRVARSKVAPSSITYAILVDCCCRAGRQDLGHTAMGHVIKMGFLADAIITFSHLLKAICAENKTSYAMDIVLRVMPMFNCVPSIFSYSILFKGLCNERRSQEALELINIMVEDGRGSCQPNVVSYTTVIDGLLKEGEVGKAYSLFCVMLQRGISPNVVTCTSIISGMCKVHAMDKAEEVLQQMTNRGILPNSATYNSLIHGYYSLGQCEEVDRILMEMSRNGVQPNVVTYNIQMDYLCKSGRCAEARKIFDSMISLGPKPTITTYNILLHGYAMEKSFHDMHSLIDLMVGNGIAPDHYVYNILISACAKEEMVSEVMHIFKKMRQHGLNPDVATYGAVVNLLCSMGRMDDAMYQYNQMITEGLAPDIIVFSTLISGFCTCGKWEKVHELFSEMLDRGICPNTVFFTTIMDRLCKNGRVMEAQDLFDLMVHMGVKPDVCTYNTLIGGFLFIGKMDEVRKLLDNMVSIGMKPDVITYNILIDGYCKNGRIDDALVVFREMLAGKVKPCIITFNIMLGALLKGGRKEEAKDLFDGIWAKGLVPTVVTYSLMIQKLIEEGSLQESDDLFLSMEKNGCPANSRMLNAIVRRLLQKGEMPRAGTYLSKIDERSFTIEASTASLLTALASVGKCQEYKGLLPEKYHSFLEQGTD

SEQ ID NO: 460 - protein, 716 aa, Triticum aestivum
MSRRLVPVGRRILEQNIKDRYRTGHIGTEDALQLFDELLQVAQPSSIAAINCLLTVVGRDCPALGVSLFNRVARSKVAPSSITYAILVDCCCRAGRQDLGHTAMGHVIKMGFLADAIITFSHLLKAICAENKTSYAMDIVLRVMPMFNCVPSIFSYSILFKGLCNERRSQEALELINIMVEDGRGSCQPNVVSYTTVIDGLLKEGEVGKAYSLFCVMLQRGISPNVVTCTSIISGMCKVHAMDKAEEVLQQMTNRGILPNSATYNSLIHGYYSLGQCEEVDRILMEMSRNGVQPNVVTYNIQMDYLCKSGRCAEARKIFDSMISLGPKPTITTYNILLHGYAMEKSFHDMHSLIDLMVGNGIAPDHYVYNILISACDKEEMVSEVMHIFKKMRQHGLNPDVATYGAVVNLLCSMGRMDDAMYQYNQMITEGLAPDIIVFSTLISGFCTCGKWEKVHELFSEMLDRGICPNTVFFTTIMDRLCKNGRVMEAQDLFDLMVHMGVKPDVCTYNTLIGGFLFIGKMDEVRKLLDNMVSIGMKPDVITYNILIDGYCKNGRIDDALVVFREMLAGKVKPCIITFNIMLGALLKGGRKEEAKDLFDGIWAKGLVPTVVTYSLMIQKLIEEGSLQESDDLFLSMEKNGCPANSRMLNAIVRRLLQKGEMPRAGTYLSKIDERSFTIEASTASLLTALASVGKCQEYKGLLPEKYHSFLEQGTD

SEQ ID NO: 461 - protein, 716 aa, Triticum aestivum; identical to SEQ ID NO: 460

SEQ ID NO: 462 - protein, 716 aa, Triticum aestivum; identical to SEQ ID NO: 460

SEQ ID NO: 463 - protein, 612 aa, Triticum aestivum
MGHVIKLGFTAEAIVNFSHLLKAICAVKKTSYAMDIVLRIMPEFNCIPNIFSYNILFKGLCNEKRSQEALDLIRIMVEHGGCCQPDVVTYNTVIDGLLKEGEVGKAYSLFCEMLRQGVSPDVVTCSSIISGMCKLHAMDKAEEVLQQMLDRRILPDVATYNSLIHGYYSLGQCEEVDRIFKEMTTNGVQPDIVTYNIQMDYLCKNGRCAEARKIFDSMISLGQKPTVTTYNILLHGYAMERSFHDMNCLIELMDDNGISPDHYGYNILISAYAKEKMVDDVLHIFTKMRQQGLNPDVANYGAVINLLSSIGRMDDAMSQYNQMINEGLLPGIILFSQLISGFCSCGKWEKVHELFSEMLDRGICPNTVFFNTIIDRLCKNGRVMEAQDLFDLMVHMGVKPDVCNYNTLIGGYLFIGKMDEVSKLLDNMCSIGLNPNVFTYGILIDGYSKNGSIGDALVVFREMLEGKVKPSIISFNIMIGALLKCGRKEEAKDLFDGIWANVLVPDVVTYRLMIHKLIEEGSLQESDDLFVSMEKDGCAADSRMLNAIVRRLLQKGEMPRAGTYLSKIDERRFTLEASTASLLTALVSGGKGQEYKELLPKKYQSFLEQGTD

SEQ ID NO: 464 - protein, 714 aa, Triticum aestivum
MSRRLVPVGRRILERKIEERYCAGDIGTDDALNLFYELIQVARPSSIRAINCLLTVVRRDCPALGVSLFNRVARAKVPPHNITYGILVDCCCRAGRLDLGHAAMGHVIKLGFAAQAVVNFSHLLKAICAEKKTSYAMDIVLRVIPMFNCVPDVFSYSILFKGLCNERRSQEALELIHIMVQHGGSCQPNVVSYSTVIDGLLKEGEMNKAYSLFCEMLQRGISPNVVTCSSIISGMCKLHAMDKAEEVLQQMLDRGILPNSTTYNGLIHGYYSLEQCEEVGRIFKEMSRNGVQPNIVTYNIQMDYLCKSGRCAEARKIFDSMVSLGQKPDVTTYGILLHGYAMERSFHDIHCLIDLMVGNGLSPNNYIYSILISACAKEKMVDEAMHIFTKMRQQGFNPDVVSYGMVIDLLSSIGRMDDAMSQFNQMITEGLAPDIIVFNPLISGFCSCGKWEKVHELFSEMLDRSICPDRVFFNTVMDHLCKSERVMEAQDVLDLMIHMGVKPVVRDYNRLIHGYFLVGKMDEGRKLLDNMCSIGLKPNVVTYNILIDGYSKNGRIDDALVVFRETLDNVKVSVITFTIMIGALLKCGRKEEAKDMFDGIWANGLVPDVVTYSLMIQKLIEEGSLQESDDLFISMEKNGCAADSRLLNAIVRSLLQKGEILRAGTYLSKIDERSFTLEASTASLLTALASGGKGQEYKELLPEKYHSFLEQGTD

SEQ ID NO: 465 - protein, 714 aa, Triticum aestivum; identical to SEQ ID NO: 464

SEQ ID NO: 466 - protein, 724 aa, Triticum aestivum
MGLGRQNPMGFVPVAIWSRTSPCSALSCLQRWPRPCRHPLQPHVPRRWCTRVVSPTCCTYSILMDCCCRADRPDLVVAFFGHLLRLGLRLNVISFNNLLKGLCQAKRSNEAVDLLLHRTPELDSVPNVFSYGIVINGCFKQGEVDKACNLFHEMIQLGVQPNVVIYTSIIDALSKCGAMDKAEVVLQQMVDQGIEPNIRTYTSLVHGYSASGQWKAAVRVFKEMVSVGILPNAFTLNSFMDSLCKHRRTKEARVIFDSMAAKGQKPNIVSYSTMLNGYAKEGCFDDMTCFLNLMLQNGVVPDHHVFNILINACAKRGLMDEAMHMFEVMRQQGVNPDVFGYQIIMDSLCKKGKMDAALEKFNQMVNEGVSPNKAVYQCLVLGSCSHDHFLKAKELISEAVNRGLCSNSAFFYPVINDLCKEGKVKEAQDMFDFIVGIGQRPDVIMYNSLMDGYCLVGKVEEALRVLDAMKSAGLQPTAVTYDILLNGYCKIGRIAAGLSLFMEMSLSGVKPTTIMYNIILDGLFRSGRTDSAKEKFRTMSESGIPVGIGTYNIVLSGLCKNNCTGEAIELFKKLRAMNVKIDVKTLTIMISAMFKSRRIEEAKELFATISAIGLVPSVVTYSVMMTNFIKEGSLAEADDMFLAMEKASCAPNSMLLNQVVRALLKKGAVVKAATYLAKLDAKQLSVEASMISLIVFLFSGEGKLREHVELLPVKYQPPESSADN

SEQ ID NO: 467 - protein, 715 aa, Triticum aestivum
MSRRVVPVGRRILEQNIKARYHAGDIGTEDALHLFDELLQDAGRSSIHAINCLLTVVGRDCPALGVSLFNRVARSKVAPSSITYAILVDCCCRAGRQDLGHTAMGHVIKMGFLADAIITFSHLLKAICAENKTSYAMDIVLRIMPEFNCMPNIFSYNILFKGLCNEKRSQEALELIQIMVEDGGCCRPDVVTYSTVIDGLLKEGEVGKAYSLFCEMLRQGVSPDIVTCSSIISGMCKLHAMDKADEVLQQMLDRRILPDVATYNSLVHGYYSLGQCEEVDRVLKEMSRNGVQPNIVTYNIQMDYLCKSGRCAEARKIFDFMIGLGQKPDVTTYSVLLHGYAMEKSFHEMHCLIDLMVGNGISPDHHVYNILISAYAKEEMVGEVLHIFTKMRQQGLNPNVVNYGAVINLLSSIGRMDDAMSQFSQMITEGLAPDVIVFNSLISGFCSCGKWEKVHELFSEMFDRGICPDTVFFNTVMDHLCKNGRVMEAQDVFDLMVHMGVKPFVRDYNTLIHGYCLVGKMDEGRKLLDNMFSIGSKPDDFTYSILIDGYSKKGRIDDALIVIKEMLDGKVKPSIITFNIMIGALLKGGRKEEAKDLFDGIWAKGLVPDVVTYSLMIQKLIEEGSLQESDDLFLSMEKNGCAADSRMLNAIVRSLLQKGEVPRAGTYLSKIDERRFTPEASTASLLTALVSGGKGQEYKELLPEKYHSFLEQGTG

SEQ ID NO: 468 - protein, 715 aa, Triticum aestivum; identical to SEQ ID NO: 467

SEQ ID NO: 469 - protein, 715 aa, Triticum aestivum
MNRRVVPVGRRILEQNIKARYHAGDIGTEDALHLFDELLQDAGRSSIHAINCLLTVVGRDCPALGVSLFNRVARSKVAPSSITYAILVDCCCRAGRQDLGHTAMGHVIKMGFLADAIITFSHLLKAICAENKTSYAMDIVLRIMPEFNCMPNIFSYNILFKGLCNEKRSQEALELIQIMVEDGGCCRPDVVTYSTVIDGLLKEGEVGKAYSLFCEMLRQGVSPDVVTCSSIISGMCKLHAMDKAEEVLQQMLDRRILPDVATYNSLVHGYYSLGQCEEVDRVLKEMSRNGVQPNIVTYNIQMDYLCKSGRCAEARKIFDFMIGLGQKPDVTTYSVLLHGYAMEKSFHEMHCLIDLMVGNGISPDHHVYNILISAYAKEEMVGEVLHIFTKMRQQGLNPNVVNYGAVINLLSSIGRMDDAMSQFSQMITEGLAPDVIVFNSLISGFCSCGKWEKVHELFSEMFDRSICPDTVFFNTVMDHLCKNGRVMEAQDVFDLMVHMGVKPFVRDYNILIHGYCLVGKMDEGRKLLDNMFSIGSKPDDFTYSILIDGYSKKGRIDDALIVIKEMLDGKVKPSIITFNIMIGALLKGGRKEEAKDLFDGIWAKGLVPDVVTYSLMIQKLIEEGSLQESDDLFLSMEKNGCAADSRMLNAIVRILLQKGEVPRAGTYLSKIDERRFTPEASTASLLTALVSGGKGQEYKELLPEKYHSFLEQGTG

SEQ ID NO: 470 - protein, 715 aa, Triticum aestivum
MSRRFVPVSRRILEQNIKAPYHAGDIGTEDALHLFDELLQVAGRSSIHAINCLLTVVCHDCPALGVSLFNRVARSKVAPCSITYAILVDCCCRAGRLDLGHTAMGHIIKMGFTADAMITFSHLLKAICAENKTSYAMDIVLRIMPMFNCVPNNFSYNILFKGLCNERRSQEALELIHMMVQHGGSCQPNVVSYNTVVDGLLKEGEVGKAYTLFSEMLRQGISPDVVTCRSIISGMCKVHAMDKAEEVLQQMLDRRILPDVATYNSLIHGYYLLGQCEEVDRIFKEMSRNGVQPNVVTYTIQMDYLCKSGRCAEARKIFDSMISLGQKPDVYTYSILLHGYAMEKSFHDMHCLIDLMVENGIAPDHHVYNILISACAQEEMVSDVMHIFTKMRQQGLNPNVANYGVVVNLLCSMGRMDDAMYQYNQMITEGLDPDIIVFSTLISGFCSCGAWERVHEIFSEMLNRGIYPDTVFFNIIMDHLCKEGRVMEAQDIFDLMVHMGVKPFVRDYNTLIHGYCLVGKMDEGRKLLDNMCSIGLKPDDFTYSILIDGYSMKGRIDDALIVVRELLDGKVGPSIITFNIMIVALLKGGRKEEAKDLFDGIWAKGLVPDVVTYSLMIQKLIEEGSLQESDDLFLSMEKNGCAADSRMLNAIVRSLLQKGDVPRAGTYLSKVDERSFTLEGSTATLLTALASGRKGQEYKGLLPEKYHSFLEQDTG

SEQ ID NO: 471 - protein, 715 aa, Triticum aestivum; identical to SEQ ID NO: 470

SEQ ID NO: 472 - protein, 600 aa, Triticum aestivum
MAGPKSHLLKAICAENKTSYAMDIVLRIMPMFNCVPNNFSYNILFKGLCNERRSQEALELIHMMVQHGGSCQPNVVSYNTVVDGLLKEGEVGKAYTLFSEMLRQGISPDVVTCRSIISGMCKVHAMDKAEEVLQQMLDRRILPDVATYNSLIHGYYLLGQCEEVDRIFKEMSRNGVQPNVVTYTIRMDYLCKSGRCAEARKIFDSMISLGQKPDVYTYSILLHGYAMEKSFHDMHCLIDLMVENGIAPDHHVYNILISACAQEEMVSDVMHIFTKMRQQGLNPNVANYGVVVNLLCSMGRMDDAMYQYNQMITEGLDPDIIVFSTLISGFCSCGAWERVHEIFSEMLNRGIYPDTVFFNIIMDHLCKEGRVMEAQDIFDLMVHMGVKPFVRDYNTLIHGYCLVGKMDEGRKLLDNMCSIGLKPDDFTYSILIDGYSMKGRIDDALIVVRELLDGKVGPSIITFNIMIVALLKGGRKEEAKDLFDGIWAKGLVPDVVTYSLMIQKLIEEGSLQESDDLFLSMEKNGCAADSRMLNAIVRSLLQKGDVPRAGTYLSKVDERSFTLEGSTATLLTALASGRKGQEYKGLLPEKYHSFLEQDTG

SEQ ID NO: 473 - protein, 715 aa, Triticum aestivum; identical to SEQ ID NO: 470

SEQ ID NO: 474 - protein, 715 aa, Triticum aestivum; identical to SEQ ID NO: 470

SEQ ID NO: 475 - protein, 715 aa, Triticum aestivum; identical to SEQ ID NO: 470

SEQ ID NO: 476 - protein, 715 aa, Triticum aestivum; identical to SEQ ID NO: 470

SEQ ID NO: 477 - protein, 715 aa, Triticum aestivum
MSRRFVPVGRRILEQNIKARYHAGDIGTEDALHLFDELLQVAGRSSIHAINCLLTVVGRDCPALGVSLFNRVARAKVAPCSITYAILVDCCCRTGRQDLGFAAMGHVIKMGFTADAMITFSHLLKAICAENKTSYAMDIVLRIMPMFNCIPDVFSYNILFKGLCNEKRSQEALELIQVMVEHGGRCQPDVVSYSTVIDGLLKEGLVGKVYILFCEMIQRGISPNAVTYNSIISGMCKVHAMDKAEQVLQQMPDRGILPNVATYTSLIHGYFSLGQCKEVDRIFKEMSRNGVQPNVVTYNIQMDYLCKNGRCAEARKIFDSMVSLGQKPTVTTYSILLHGYALERSFHEIHCLIDLMVGNGIAPNHFLYNILISAYAKEEMIGEVMHIFKKMRQHGLNPNVATYGAVVNLLSKIGRMDDAMSQFNQMITEGLAPDIIVFTLLISGFCSCGKWEKVDELFSEMLDRGICPNTVFFNIIMDCLCKNERVMEAQDLFDLMVHMGVKPDVCTYNTLIGGYLFIGKMDEVRKLLDNMVSIGLKPNVITYSILIDGYSKNGSIDDALVVSREMLAGKVKPCVITFNIMIGALLKCGRKAEAKDLFDGIWANGLVPDVITYSLMIQKLIEEGSLQESDDLFLSMEKNGCVADSHMLNAIVRSLLQKGEVPRAGTYLSKIDERRFTFEASTASLLVALASGRKSQEYKELLPEKYHYFLEEGTD

SEQ ID NO: 478 - protein, 415 aa, Triticum aestivum
MSRRFPPGAMSRRILERKIQDRYHAGHIGTHNALNLFDELIQVAGPSSVRAINCLLTVVGRDCPVLGVSLFNRVARAKVPPHNITYSILVDCCCRAGCLDLGHAAMGHVIKLGFTEAIVNFSHLLKAICAEKKTSYAMDIVLRIMPMFNCVPNIFSYSIVFKGLCNEKRSQEALELIQIMVEDGGCCRPDVVTYSTVIDGLLKEGEVDQAYNLFSEMLRQGVSPNVVTCSSIISGMCKAQSVDKAKEVLQQMFERGILPNITTYNSLIQGYYSLGRCKEVDQIFKEMTINGVQPDIITYNIQMDYLCKSGQCAEARKIFDSMISLGQNPTATTYSILLHGYAMEKSFHDMHCLIDLMVENGISPDHYVYNILISAYAKEEMVGEVMHIFTKMRQQGLNPDAVSYGTVIDLLSRIG

SEQ ID NO: 479 - protein, 415 aa, Triticum aestivum; identical to SEQ ID NO: 478

SEQ ID NO: 480 - protein, 717 aa, Triticum aestivum
MSRRFPPGAMSRRILERKIQDRYHAGHIGTHDALNLFDELIQVAGPSSVRAINCLLTVVGRDCPALGVSLFNRVARAKVPPHNITYSILVDCCCRAGRLDLGHAAMGHVIKLGFTEEAIVNFSHLLKAICAEKKTSYAMDIVLRIMPMFNCVPNIFSYSIVFKGLCNEKRSQEALELIQIMVEDGGCCRPDVVTYSTVIDGLLKEGEVDQAYNLFSEMLRQGVSPNVVTCSSIISGMCKAQSVDKAKEVLQQMFERGILPNITTYNSLIQGYYSLGRCKEVDQIFKEMTINGVQPDIITYNIQMDYLCKSGQCAEARKIFDSMISLGQNPTATTYSILLHGYAMEKSFHDMHCLIDLMVENGISPDHYVYNILISAYAKEEMVGEVMHIFTKMRQQGLNPDAVSYGTVIDLLSRIGRMDDAMSLFNQMITEGLAPGTIVFNHLISGFCTCGKWEKVHELFSEMLDRGICPDTVFFNTVMDRLCKNGRVTEAQDLFDLMVHMGVKPDVCTYNTLMGGYLFIGKMDEVSKLLENMCSIGLKLDVVTYSILIDGYSKNGRIDDALVVFREMMDGKVKPSVITFNIMIGALLKGGRKEEATDLFNGIWPKGLVPDVVTYSLMIQKLIEEGSLQESDDLFLSMEKNGCAADSRMLNAIVRSLLQKGEVPRAGSYLSKIDERSFTLEASTASLVTALASGGKGQEYKELLPEKYHSFLEHGTD

SEQ ID NO: 481 - protein, 415 aa, Triticum aestivum; identical to SEQ ID NO: 478

SEQ ID NO: 482 - protein, 614 aa, Triticum aestivum
MGHVIKLGFTEEAIVNFSHLLKAICAEKKTSYAMDIVLRIMPMFNCVPNIFSYSIVFKGLCNEKRSQEALELIQIMVEDGGCCRPDVVTYSTVIDGLLKEGEVDQAYNLFSEMLRQGVSPNVVTCSSIISGMCKAQSVDKAKEVLQQMFERGILPNITTYNSLIQGYYSLGRCKEVDQIFKEMTINGVQPDIITYNIQMDYLCKSGQCAEARKIFDSMISLGQNPTATTYSILLHGYAMEKSFHDMHCLIDLMVENGISPDHYVYNILISAYAKEEMVGEVMHIFTKMRQQGLNPDAVSYGTVIDLLSRIGRMDDAMSLFNQMITEGLAPGTIVFNHLISGFCTCGKWEKVHELFSEMLDRGICPDTVFFNTVMDRLCKNGRVTEAQDLFDLMVHMGVKPDVCTYNTLMGGYLFVGKMDEVSKLLDNMVSIGMEPDVITYSILIDGYSKNGRIDDALVVFREMLDTKGKPSVISFNIMIGALLKCGRKEEAKDLFDGIWANGLVPDVITYSLMIQKLIEEGSLQESDDLFLSTEKNGCAADSRRLNAIVRSLLQKGEIPRAGTYLSKIDERGFTLEASTASLLTALASGGKGQEYKELLPEKYHSFLEQGTLNF

SEQ ID NO: 483 - protein, 715 aa, Triticum aestivum
MSRRFVPVDRRILERNIKDRYHAGCIGTEDALHLFDELLQVAGPSSIPAINCLLTVVGRDCPALGVSLFNHVARAKVPPHNITYGILVDCCCRAGRLDLGHAAMGHVIKLGFTAEAIINFSHLLKAICAEKKTSYAMDIVLRIMPEFNCIPNIFSYNILFKGLCNEKRSQEALELIQIMVEDGGCCRPDVVTYSTVIDGLLKEDEVDQAYSLFSEMLRQGVSPNVVTCNSIISGMCKLHAMDKAEEVLQQMLDRRILPDVTTYTSLIHGYYSLGQCEEVDRVFIEMSRNGVQPNIITYSIQMDYLCKNGRCTEARKNFDFMISLGQKPTVTTYNIMLHGYAMERSFHDMNCLIDLMDDNGISPDHYGYNILIFAYAEEKMVDEVMHIFTKMRQQGLNPDAVSYGTVIDLLSRIDRMDDAMSQFNQMITEGLVPDIVVFNPLIRGFCSCGKWEKVDELFSEMLDRGICPNIVFFTTIMDRLCKNGRVMEAQDLFDLMVHMGVKPDVCTYNILIGGYLFIGKMDEVSKLLDNMVSIGMEPDVITYNILIDGYSKNGRIDDAFVVFREMLAGKVKPCIITFNIMLGALLKGGRKEEAKDLFDGIWAKGLVPTVVTYSLMIQKLIEEGSLQESDDLFVSMEKNGCAADSHIINAIVRSLFRKGEVPRAGTYLSKIDERSFTLEASTAILLTALASGGKGQEYKELLPEKYHSFLEQGTD

SEQ ID NO: 484 - protein, 715 aa, Triticum aestivum; identical to SEQ ID NO: 483

SEQ ID NO: 485 - protein, 715 aa, Triticum aestivum; identical to SEQ ID NO: 483

SEQ ID NO: 486 - protein, 715 aa, Triticum aestivum; identical to SEQ ID NO: 483

SEQ ID NO: 487 - protein, 715 aa, Triticum aestivum; identical to SEQ ID NO: 483

SEQ ID NO: 488 - protein, 715 aa, Triticum aestivum
MSRRFVPVDRRILERNIKDRYHAGCIGTEDALHLFDELLQVAGPSSIPVINCLLTVVGHDCPALGVSLFNHVARAKVPPHNITYGILVDCCCRAGRLDLGHAAMGHVIKLGFTAEAIINFSHLLKAICAEKKTSYAMDIVLRIMPEFNCIPNIFSYNILFKGLCNEKRSQEALELIQIMVEDGGCCRPDVVTYSTVIDGLLKEDEVDQAYSLFSEMLRQGVSPNVVTCNSIISGMCKLHAMDKAEEVLQQMLDRRILPDVTTYTSLIHGYYSLGQCEEVDRVFIEMSRNGVQPNIITYSIQMDYLCKNGRCTEARKIFDFMISLGQKPTVTTYNIMLHGYAMERSFHDMNCLIDLMDDNGISPDHYGYNILIFAYAEEKMVDEVMHIFTKMRQQGLNPDAVSYGTVIDLLSRIDRMDDAMSQFNQMITEGLVPDIVVFNPLIRGFCSCGKWEKVDELFSEMLDRGICPNIVFFTTIMDRLCKNGRVMEAQDLFDLMVHMGVKPDVCTYNILIGGYLFIGKMDEVSKLLDNMVSIGMEPDVITYNILIDGYSKNGRIDDAFVVFREMLAGKVKPCIITFNIMLGALLKGGRKEEAKDLFDGIWAKGLVPTVVTYSLMIQKLIEEGSLQESDDLFVSMEKNGCAADSHIINAIVRSLFRKGEVPRAGTYLSKIDERSFTLEASTAILLTALASGGKGQEYKELLPEKYHSFLEQGTD

SEQ ID NO: 489 - protein, 715 aa, Triticum aestivum; identical to SEQ ID NO: 483

SEQ ID NO: 490 - protein, 713 aa, Triticum aestivum
MSRRFPTVGRRILERKIQDRYRAGHIGTDDALNLFDELIQLAGPSSVRAINCLLTVVGRDCPALGIFLFNRVARAKVPPHNITYGILVDCCCRAGRLDLGHAAMGHVIKLGFAAEAIVNFSHLLKAICAEKKTSYAMEIVLRIMPMFNCVPNIFSYSILFKGLCNEKRSQEALELIHIMVDHGGSCQPNVVSYNTVVDGLLKEGEAGKAYSLFSEMLQREILPDVVTYNSIISGMCKVHAMDKAEEVLRQMFDRGILPDIATYTSLIHGYYSSGQCKEVERVFNEMSRNGVQPNMVTYNIQMDYLCKSGRCTEARKIFDSLIDLGQKLTVTTYSILLHGYALERSLHGMHCLIDLMVGNGISPDHHVYNILISVYAKEGMVGEVMHIFTKMRQQGLNPDVVNYGTVINLLCSIGRMDDAMLQFSQMITEGLAPNIIVFTPLISGFCTYGKWEKVHELFSEMFDRGIYPDTLFFTTVMDRLCKNERVMEAQDIFDLMGHMGVKPDVCTYNTLIGGYLFVGKMDEVRKLLDNMVSIGMEPDVITYSRLIDGYSKNGRIDDALVVFWEMLDGKVKPSVITFNIIIGALLQGGRKEEAKDLFDCIWAKGLVPDVVTYSLMIQKLIEEGSLQESDDLFISMEKNGCAADSRMLNAIVRSLLQKEEILRAGTYLSKIDERRFTLEASTASLLTALVSGGKGQEYKELLPENYSELLIEA

SEQ ID NO: 491 - protein, 691 aa, Triticum aestivum
MSRRAVPAGRRILEQNIKARYRAGNIGTEDALHLFDELLPVARPSSVPAINCLLIVVGRDCPALAVSLFNRIARTKVAPQNITYGILVDCCCLAGRLDLGFAAMGHIIKTGFAAGSVISFSHLLRAVCAEKKTSYGMDIVLRIMPELNCTPDVYSYSILFKGLCNEKRSQEALELIHVMVEHGGSCQPNLVSYSTVIDGLLKEGEVGKAYSLFCEMVHRGISPDIVTYNSIISGMCKVHAMDKAEKVLQQMFDREILPDTTTYTSLIHGYYSSGQCKEVERVFEHMSINGVQPNMITYNIQMDYLCKSGRCAEARKIFDSMVSLGQKPSVTTYSILLHGYAMEKSFHDMHCLIDLMVENGISPDHYVYNMLISACPKEEMFGEVMHIFTKMRQQGLNPNVANYGAVINLLSSAGKMDDAMCQFNQMITEGLAPDIVIFNTLISGFCTCGKWEKVHELFSEMLNRGIYPDIVSFTILMDRLCKSGRVIEAQDMFDLMVRIGVKPNIHTYGTLMHGYFFVRKVDEVRKLLGNMLSTGLKPDVFTYTILIDGYFKNGMIDDASAVFTEMLEKKVEPSVITYRTMRYGLLNSGRTVAATKLYLRMIDSGIHVDIAAYNIILRGLCKNNCVDGALRMFQHLSSTNYPLEVGTYNIMISALVKGGRKEEATDLFDDMLAKGLVPDAVMYSLIKKGVV

SEQ ID NO: 492 - protein, 691 aa, Triticum aestivum; identical to SEQ ID NO: 491

SEQ ID NO: 493 - protein, 691 aa, Triticum aestivum; identical to SEQ ID NO: 491

SEQ ID NO: 494 - protein, 691 aa, Triticum aestivum; identical to SEQ ID NO: 491

SEQ ID NO: 495 - protein, 691 aa, Triticum aestivum; identical to SEQ ID NO: 491

SEQ ID NO: 496 - protein, 691 aa, Triticum aestivum; identical to SEQ ID NO: 491

SEQ ID NO: 497 - protein, 663 aa, Triticum aestivum
MDCCCRANRQDLALAFFGRLLRTGLKAGVIEVNTLLKGLCRAKRADEALDILLHRMPELGCAPNVVAYTTVIHGFFKEGQVSKACNLFHEMALQGVTPDVVTYNSVIDALCKARAMDNAEYFLRQMVDNGVVPNNVTYSSLIHGYSSSGHWKEAVRVFKEMTGRRVTPDVHTYNMFMTFLCKHGRSKEAAGIFDTMAMKGLKPDNVSYAIRLHGYATEGCLVDMINLFNSMERDCILPDCHIFNILINAYAKSGKLDKAMLIFNEMQKQGVSPNAVTYSTIIHAFCKKGRLDDAVIKFNQMIDTGVRQGTAVYRSLIQGFCTHGDLVKAKELLTEMMNKGIPPPDIKFFHSIMQNLCTEGRVIEARDILGLIAHIGMRPNVCTFNILIGGYCLVGKMEDASKIFDDMMSYGLEPSNITYGILINGYCKNRRIDDGLILFKEMLRKGLKPTTFNYNVILDGLFLAGQTVAAKEKFDEMVESGVSVCIDTYSIVLGGLCRNSCSSEAITLFRKLSAMNVKFNITIVNTIIGAFYRVERNQEAKDLLAAIPASGLVPNVVTYTIMIKNLIKEGSVEEADNLFLSIEKSGCSANSYLLNHIIRRLLEKGETVKAGNYMSKVDAKSYSLEAKTVSLLISLFSRKGKYREHIKLLPTKYQFLEEAATVE

SEQ ID NO: 498 - protein, 267 aa, Triticum aestivum
MEDASKIFDDMMSYGLEPSNITYGILINGYCKNERINDGLILFKEMLRKGLKPTTFNYNIILDGLFLAGQTVAAKEKFDEMVESGVSVCIDTYSIVLGGLCRNSCSSEAITLFRKLSAMNVKFNITIVNTIIGAFYRVERNQEAKDLFAAIPASGLVPNVVTYTIMIKNLIKEGSVEEADNLFLSMEKSGCSANFYLLNHIIRRLLEKGEIVKAGNYMSKVDAKSYSLEAKTVSLLISLFSRKGKYREHIKLLPTKYQFLEEAATVE

SEQ ID NO: 499 - protein, 663 aa, Triticum aestivum
MDCCCRANRQDLALAFFGRLLRTGLKAGVIEVNTLLKGLCRAKRADEALDILLHRMPELGCAPNVVAYTTVIHGFFKEGQVSKACNLFHEMALQGVTPDVVTYNSVIDALCKARAMDKAEYFLRQMVDNGVVPNNVTYSSLIHGYSSSGHWKEAVRVFKEMTGRRVTPDVHTYNMFMTFLCKHGRSKEAAGIFDTMAMKGLKPDNVSYAIRLHGYATEGCLVDMINLFNSMERDCILPDCHIFDILINAYAKSGKLDKAMLIFNEMQKQGVSPNAVTYSTIIHAFCKKGRLDDAVIKFNQMIDTGVRQGTAVYRSLIQGFCTHGDLVKAKELLTEMMNKGIPPPDIKFFHSIMQNLCTEGRVIEARDILGLIAHIGMRPNVCTFNILIGGYCLVGKMEDASKIFDDMMSYGLEPSNITYGILINGYCKNRRIDDGLILFKEMLRKGLKPTTFNYNVILDGLFLAGQTVAAKEKFDEMVESGVSVCIDTYSIVLGGLCRNSCSSEAITLFRKLSAMNVKFNITIVNTIIGAFYRVERNQEAKDLFAAIPASGLVPNVVTYTIMIKNLIKEGSVEEADNLFLSIEKSGCSANSYLLNHIIRRLLEKGETVKAGNYMSKVDAKSYSLEAKTVSLLISLFSRKGKYREHIKLLPTKYQFLEEAATVE

SEQ ID NO: 500 - protein, 259 aa, Triticum aestivum
MNCCCRVCRPDLGFALFGRLLRRGLKTDDIVTNTLLKCLCCAKRTDEAVSVLLHRMSKLGCVPDVISYNTVLKSLCDNSSSQRALDLLQMMTKGGGCSPDVVTYNTVIHGFLQEGEVSKACDRYHEMVQQGVLHDVVTYNSILDALCKAGAMDKAELFLQQMADDDIRPNEVTYNAMIHGYSTLGQWKRATQMFREMTSRGLAPNIVTWSSLMTSLCKHGRSKEAAEIFIPWLQKATSLTSLRIVFCFTGMPLRDSLQI

SEQ ID NO: 501 - protein, 607 aa, Triticum aestivum
MMTKGGGCSPDVVTYNTVIHGFLQEGEVSKACDLYHEMVQQGVLHDVVTYNSILDALCKAGAMDKAELFLRQMVDDDIRPNEVTYNAMIHGYSTLGQWKKATQMFREMTSRGLAPNIVTWSSLMTSLCKHGRSKEAAEIFHSMAAKGHKPNIVTYRVLLHGYAAEGFFADMIDLFNSMANNGIVPDCHVFNILINAYAKCGMMDEAMSMLTEMRGQGVSPDVFTYATVIAALCRMGRLTDAMDNFNRMIGKGVQPSKVVYHSLIQGFCTHGNLVKVKELIFGMTDKGIPHPNIVFFSSIMHSLCNEGRVMDAHHIFDLVIDIGERPDLITFNTLIDGYCLVSKMEEALRLLDSMVSAGIKPNVITYNTLINGYCRSGRLDDGVILFREMLHTRVKPNTVTYNIILDGLFRAGRTVAAKKMFHEMIETGTAVSISTYSIVLGGLCRNNCTDEAITFFQKLVAMNVKSDIAILNTMIKAMYKVQRREEANDLFASLPAYGLVPNAATYRVMISNLLKEGSLEEADNMFSSMEKSGCAPSSRLVNDIIRKLLEKGEIVKAGNYMSKVDGKIISFEASTTSLLLSLFSEKGKYREQLQLLPAKYQLFEGVI

SEQ ID NO: 502 - protein, 465 aa, Triticum aestivum
MAAKGHKPNIVTYRVLLHGYAAEGFFADMIDLFNSIANNGIVPDCHVFNILINAYAKCGMMDEAMSMLTEMRGQGVSPDVFTYATVIAALCRMGRLTDVMDNFNRMIGKGVQPSKVVYHSLIQGFCTLGDLVKVKKLIFEITDKGIPHPNIVFFSSIMHSLCNEGRVMDAHHIFDLVIDIGERPDLITFNMLIDGYCLVSKMEEALRLLDSMVSAGIKPNVITYNTLINGYCRSGRLDDGVILFREMLHTRVKPNTVTYNIILDGLFRAGRTVAAKKMFHEMIETGTAVSISTYSIVLGGLCRNNCTDEAIAFFQKLVAMNVKFDIVILNTMIKAIYKVQRREEANDLFALLPACGLVPNASTYGVVIQNLLKEGSLEEADNMFSSMEKSGCAPSSRLVNDIIRKLLEKGEIVKAGNYMSKVDGKIISFEVSTTSLLLSLFSEKGKYREQLQLLPAKYQFFEGVI

SEQ ID NO: 503 - protein, 607 aa, Triticum aestivum; identical to SEQ ID NO: 501

SEQ ID NO: 504 - protein, 607 aa, Triticum aestivum
MMTKGGGCSPDVVTYNTVIHGFLQEGEVSKACDLYHEMVQQGVLHDVVTYNSILDALCKAGAMDKAELFLRQMVDDDIRPNEVTYNAMIHGYSTLGQWKKATQMFREMTSRGLAPNIVTWSSLMTSLCKHGRSKEAAEIFHSMAAKGHKPNIVTYRVLLHGYAAEGFFADMIDLFNSMANNGIVPDCHVFNILINAYAKCGMMDEAMSMLTEMRGQGVSPDVFTYATVIAALCRMGRLTDAMDNFNRMIGKGVQPSKVVYHSLIQGFCTHGNLVKVKELIFEMTDKGIPHPNIVFFSSIMHSLCNEGRVMDAHHIFDLVIDIGERPDLITFNTLIDGYCLVSKMEEALRLLDSMVSAGIKPNVITYNTLINGYCRSGRLDDGVILFREMLHTRVKPNTVTYNIILDGLFRAGRTVAAKKMFHEMIETGTAVSISTYSIVLGGLCRNNCTDEAITFFQKLVAMNVKSDIAILNTMIKAMYKVQRREEANDLFASLPAYGLVPNAATYGVMISNLLKEGSLEEADNMFSSMEKSGCAPSSRLVNDIIRKLLEKGEIVKAGNYMSKVDGKIISFEASTTSLLLSLFSEKGKYREQLQLLPAKYQFFEGVI

SEQ ID NO: 505 - protein, 696 aa, Triticum aestivum
MNCCCRVCRPDLGFALFGRLLRTGLKTDDIVTNTLLKCLCCAKRTDEAVSVLLHRMSKLGCVPDAISYNTVLKSLCDNSSSQRALDLLQMMTKGGGCSPDVVTYNTVIHGFLQEGEVSKACDRYHEMVQQGVLHDVVTYNSILDALCKAGAMDKAELFLRQMVDDDIRPNEVTYNAMIHGYSTLGQWKRATQMFREMTSRGLAPNIVTWSSLMTSLCKHGRSKEAAEIFHSMAAKGHKPNIVTYRVLLHGYAAEGFFADMIDLFNSIANNGIVPDCHVFNILINAYAKCGMMDEAMSMLTEMRGQGVSPDVFTYATVIAALCRMGRLTDVMDNFNRMIGKGVQPSKVVYHSLIQGFCTLGDLVKVKKLIFEITDKGIPHPNIVFFSSIMHSLCNEGRVMDAHHIFDLVIDIGERPDLITFNMLIDGYCLVSKMEEALRLLDSMVSAGIKPNVITYNTLINGYCRSGRLDDGVILFREMLHTRVKPNTVTYNIILDGLFRAGRTVAAKKMFHEMIETGTAVSISTYSIVLGGLCRNNCTDEAIAFFQKLVAMNVKFDIVILNTMIKAMYKVQRREEANDLFASLPACGLVPNASTYGVVIQNLLKEGSLEEADNMFSSMEKSGCAPSSRLVNDITRKLLEKGEIVKAGNYMSKVDGKIISFEASTTSLLLSLFSEKGKYREQLQLLPAKYQFFEGVI

SEQ ID NO: 506 - protein, 607 aa, Triticum aestivum; identical to SEQ ID NO: 504

SEQ ID NO: 507 - protein, 607 aa, Triticum aestivum; identical to SEQ ID NO: 501

SEQ ID NO: 508 - protein, 307 aa, Triticum aestivum
MSKLGCVPDAISYNTVLKSLCDNSSSQRALDLLQMMMKGGGCSPDVVTYNTVIHGFLQEGEVSKACDRYHEMVQQGVLHDVVTYNSILDALCKAGAMDKAELFLRQMVDDDIRPNEVTYNAMIHGYSTLGQWKKATQMFREMTSRGLAPNIVTWSSLMTSLCKHGRSKEAAEIFHSMAAKGHKPNIVTYRLLLHGYAAEGFFADMIDIFNSMANNGIVPDCHVFNILINAYAKCGMMDEAMSMLTEMRGQGVSPDVFTYATVIAALCRMGRLTDAMDNFNRMIGKGVQPSKVVYHSLIQGSVCMVIW

SEQ ID NO: 509 - protein, 696 aa, Triticum aestivum; identical to SEQ ID NO: 505

SEQ ID NO: 510 - protein, 465 aa, Triticum aestivum; identical to SEQ ID NO: 502

SEQ ID NO: 511 - protein, 259 aa, Triticum aestivum; identical to SEQ ID NO: 500

SEQ ID NO: 512 - protein, 696 aa, Triticum aestivum; identical to SEQ ID NO: 505

SEQ ID NO: 513 - protein, 607 aa, Triticum aestivum; identical to SEQ ID NO: 501

SEQ ID NO: 514 - protein, 696 aa, Triticum aestivum; identical to SEQ ID NO: 505

SEQ ID NO: 515 - protein, 569 aa, Triticum aestivum
MINLGVQPDAVTYSSFINALSKSGAMDKAEVVLRQMVDQGIVPNIITYTSLIHEYSTSGQWKAAVRIFKEMTSTGVRPNSVTLNSFIDSLCKHRKTKEARDIFDSMAANGHKPDIFSYSTLLNGYVKEGCFDDMTDLFNSMVRNGIVPNHHVFNILINAYAKRGLMDKAMHMFEVMRQQGVNPDVFSYQIVMDSLCKMGRMDAALDKFNQMVNQGVSPNKAVYQCLVLGSCSHGHFVKAKELISEAINRGLYSNSVFFYRVINDLCKEGKVNEAQDMFDFILGIGQRPDVIMYTSLMDGYCLVGEVEKALSVLDAMKSAGLQPDDVVYGTLLNGYCKIGRIADGLSLFREMSLSVVKPTTIIYNIILDGLFCSGRTVCAKENFDMMIESGIPVGVDTYNIVLHGLCRNNCTDEAIELFKKLCAMNVKINVITLNTMISALFKTRRIEEAKDLFATISAIGLVPSVVTYSVMMTNFIKEGLLADADDMFSAMEKAGCAPNSRLLNQVVRVFLKNGEVVKAVTYLAKLDAKQLSLEASTVSLIVSLFSRKGKLRKHVKLLPVKYQPPEMLD

SEQ ID NO: 516 - protein, 628 aa, Triticum aestivum
MDCCCRAHRLDLAFAFFGRLLRTGLKAGVIEVNTLLKGLCHTKRADEAMEVLLHRMPELGCTPDVVAYTTVIHGFFKEGQVGKACSLFHGMAQQGVAPDVMTYSSVIDALCKAKAMDKAEYFLRQMVDNGVVPDNVTYNSLIHGYSSSGHWKEAVRVLKEMTSQGIIPDIVSYRILLHGYATEGCLVDMINLFNSMARYCILPDCHIFNILINAYAKSGKLDKAMLIFREMQKQGVSPDAVTYSTVIHAFCKNGRLDDAVIKFNQMIDTGVQPNTSVYNALIQGFSTNGDLVKAKELVTEMMNKGMHPPDIKVFHSVMQNLCTEGRVTEARDILDLIVHIGMRPDVFTFTLLIGGYCLVGKMEDASKIFDDMMSYGLEPCNITYGILINGYCKNRRIDDGLILFKEMLHKGLKPTTFNYNVILDGLFLAGRTVAAKEKFDEMVESGVSVCIDTYSIVLGGLCRNNCSGEAITLFQKLSKMNVKFNIRIVNFMIDAFFRVQRKQEAEDLFAAISANGLVANVFTYSLMMTNLIKEGSAEKADTLFLSMEKSGCTANSWMLNLIIRRLLEKGEIVKAGNYMAKVDAKSYSLEAKTVSLLISLFSGKGKYREHIRLLPTKYQFREEAATVE

SEQ ID NO: 517 - protein, 668 aa, Triticum aestivum
MDCCCCRAHRLDLALAFFGHLLKTGLEADQVVFNTLLKGLCHAKRADEALDVLLHRMTELGCTPNVVAYNTIIHGFFKEGQVSKACNLFHEMAQQGVKPNVVTYNSVIDALCKARAMDKAEVVLRQMVDNGVVPDNVTYNSLIHGYSSSGHWKEAVRVFKEMTSRRVTADAHTYNMFMTFLCKHGRSKQAAGIFDSMAMKGLKPDNISYAILLHGYATEGCLVDVINLFNSIERDCILPDSRIFSILINAYAKSGKLDKAMLIFREMQKQGVSPDAFTYSTLIHAFCKKGRLDDAMIKFNQMVDTGVRQGTAVYGSLIQGFCTHGDLVKGKELVTEMMNKGIPPPDIMFFHSIMQNLCTERRVVEARDILGLIAHIGMRPNVCTFNILIGGYCLVRKMEDASKIFHDMMSYGLEPSNVTYGILINGYCKNRRIDDGLILFKEMLRKGLKPTTFNYNIILDGLFLAGRTVAAKEKFDEMVESGVSMCISTYSIVLRGLCRNNCSGEAITLFQKLSAMHVKFNIRIVNIMIDAFFRVQRKQEAKDLFAALTANGLVANVFTYSLMMTNLIKEGSVEEADTLFLSMEMSGCTSNSWMLNLIIRGLLEKGEIVKAGCYMSKVDAKSYSLEAKTVSLLIYLFSGKGKYREHIRLLPTKYQFLEEAATVEWFAI

SEQ ID NO: 518 - protein, 668 aa, Triticum aestivum; identical to SEQ ID NO: 517

SEQ ID NO: 519 - protein, 668 aa, Triticum aestivum; identical to SEQ ID NO: 517

SEQ ID NO: 520 - protein, 560 aa, Triticum aestivum
MDCCCRAHRVDLTLAFFGGLLRTGLEADQVIFSTLLKGLCHAKRTDEALNVLLHRMTELGCTPNVVAYSTVIHGFFKEGQVGKACSLFHEMAQQGVAPNLVTYTSVIDALCKAKAMDKAEYFLRQMVDNGVVPNNVTYNSLIHGYSSSSHWKEAVRVFKEMTSRRVTADVHTYNMFMTFLCKHGRSKEAAGFFDSMAMKGLKPDNVSYAILLHGYATEGCLVDMINLFNSMEKDSILPNCHIFSILINAYAKSGKLDKAMLIFSEMQKQGVSPDAVTYLPVIDAFCKKGRLDDAVIKFNQMIDMGVRPDTAVYTSLIQVFCTHGDLLKAKELVTEMMNKGIPPPDIKFFHSIMQNLCTEGRVIEARDILGLIAHIGMRPNVCTFNILIGGYCLVRKMEDASKIFDDMMSYGLEPSNITYGILINGYCKNLRIDDGLILFKEMLRKGVKPTTFNYNVILDGLFLAGRTVVAKEKFHEMVESGVSVCIGTYSIVLGGLCRNSCSSEAVTLFQKRKGAIAPGSLDSLLSGPYSLVKIRARLCIAAAHLQRQDLTATNNSARRL

SEQ ID NO: 521 - protein, 550 aa, Triticum aestivum
  misc_feature (530)..(532): Xaa can be any naturally occurring amino acid
  misc_feature (534)..(534): Xaa can be any naturally occurring amino acid
  misc_feature (537)..(537): Xaa can be any naturally occurring amino acid
  misc_feature (543)..(544): Xaa can be any naturally occurring amino acid
  misc_feature (550)..(550): Xaa can be any naturally occurring amino acid
MHSNEALDLLLHRMPELDCAPDVFSFNIVINGCFREGEVDKACNLFHEMPQLGVQPDVVTYNSIIIALSRAGAMGKAEVVLRQMVDKGIGPDVMTYNSLIHGYSTLGQWKAAVRVFKEMVSVGVLPNAVTLNSFMDSLCKHRRTKEARDIFDSMAAKGHKPNIASYSTMLNGYAKQGCFDDMTGLFNSMVQNDIVPNNHVFNILIRAYSTRGLMDEAMHMFEVMKQQGVNPDVVDYLVVIDSLCKMGRMDAAMDKFNQMVNQGVSPDIVVYQCLVLGSCSNGDFVKAKELISEAVNRGLCSNSVFFYPVINNLSKEGNVKDAQDMFDFIVGIGHQPDVIMYNSLMDGYCLVGKVEEAMTVLDAMKSAGLQPDAITYAILLNGYCKIGRIDDGLSLFREISLSRVKPTTIMYNIILDGLFCCGRTVFAKEEFDTMIESGIPVGIDTCTIVLSGLCKNNCTDEAIELFKKLCAMNVKFDVIILTTMISAMFKTRRIEEAKDLFATISTIGLVPSVVTYSVMMTNFIKEGSLXXXDXMFXAMEKAXXLEDLTX

SEQ ID NO: 522 - protein, 619 aa, Triticum aestivum
MHSNEALDMLLHRMPELDCAPDVFSFNIVINGCFREGEVDKACNLFHEMPQLGVQPDVVTYNSIIIALSRAGAMGKAEVVLRQMVDKGIGPDVMTYNSLIHGYSTLGQWKAAVRVFKEMVSVGVLPNAVTLNSFMDSLCKHRRTKEARDIFDSMAAKGHKPNIASYSTMLNGYAKQGCFDDMTGLFNSMVQNGIVPNNHVFNILIRAYSTRGLMDEAMHMFEVMKQQGVNPDVVDYLVVIDSLCKMGRMDAAMDKFNQMVNQGVSPDIVVYQCLVLGSCSNGDFVKANELISEAVNRGLCSNSVFFYPVINNLSKEGNVKDAQDMFDFIVGIGHQPDVIMYNSLMDGYCLVGKVEEAMTVLDAMKSAGLQPDAITYAILLNGYCKIGRIDDGLSLFREISLSRVKPTTIMYNIILDGLFCCGRTVFAKEEFDTMIESGIPVGIDTCTIVLSGLCKNNCTDEAIELFKKLCAMNVKFDVIILTTMISAMFKTRRIEEAKDLFATISTIGLVPSVVTYSVMMTNFIKEGSLAEADDMFLAMEKAGCAPDSRLLNHVVRVLLEKGAVVKAATYLAKLDGKQLSLEASTVSLIVSLFSRKGKLREHVKLLPVKYQPPESSTDN

SEQ ID NO: 523 - protein, 522 aa, Triticum aestivum
MHSNEALDLLLHRMPELDCAPDVFSFNIVINGCFREGEVDKACNLFHEMPQLGVQPDVVTYNSIIIALSRAGAMGKAEVVLRQMVDKGIGPDVMTYNSLIHGYSTLGQWKAAVRVFKEMVSVGVLPNAVTLNSFMDSLCKHRRTKEARDIFDSMAAKGHKPNIASYSTMLNGYAKQGCFDDMTGLFNSMVQNDIVPNNHVFNILIRAYSTRGLMDEAMHMFEVMKQQGVNPDVVDYLVVIDSLCKMGRMDAAMDKFNQMVNQGVSPDIVVYQCLVLGSCSNGDFVKAKELISEAVNRGLCSNSVFFYPVINNLSKEGNVKDAQDMFDFIVGIGHQPDVIMYNSLMDGYCLVGKVEEAMTVLDAMKSAGLQPDAITYAILLNGYCKIGRIDDGLSLFREISLSRVKPTTIMYNIILDGLFCCGRTVFAKEEFDTMIESGIPVGIDTCTIVLSGLCKNNCTDEAIELFKKLCAMNVKFDVIILTTMISAMFKTRRIEEAKDLFATISTIGLVPSVVTYSVIFFF

SEQ ID NO: 524 - protein, 632 aa, Triticum aestivum
MAFQSTAAAVLAAWTLDTAAMGHVIKLGFAEESIVNFSHLLKAICAEKKTSCAMDIVLRVMPELNCTPNIFSYSILFKGLCNEKRSQEALDLIHIMVEHGGSCQPNVVSYSTVIDGLLKEGEVNKAYSLFCEMLQRRISPDVVTCSSIISGMCKLHAMDKAEDVLQQMLDRGILPDVATYTSLMHGYYSLGQCEEVDRIFKEMSRNGVQPDIVTSNIQMDYLCKNGRCAEARKIFDSMVSLGQKPTVTTYSILLHGYAMERSFHDMNCLIDLMVGNGIAPNHFIYNILISAYAKEEMVDDVLHIFTKMRQQGLNPNVVNYGAVINLLSSFGRMDDAMSQFNQMIAEGLAPDIIVFNPLIRGFCSCGKWKKVHELFSEMLDRGIYPNTVFFNTIMDRLCKYGRVMEAQDLFDLMVHMGVKPDVCTYNTLIGGYLFVGKMDEVSKLLDNMVSIGMEPDVITYNILIDGYSKNGRIDDALVVSREMLAGKVKPCVITFNIMIGALLKCGRKEEAKDLFDGIWAKGLVPTVVTYSLMIQKLIEEGSLQESDDLFVSMEKNGCAADSHMLNAIVRSLFRKGEVPRAGTYLSKIDERSFTLEASTASLLTALASGGKGQEYKELLPEKYHSFLEQGTD

SEQ ID NO: 525 - protein, 632 aa, Triticum aestivum; identical to SEQ ID NO: 524

SEQ ID NO: 526 - protein, 632 aa, Triticum aestivum; identical to SEQ ID NO: 524

SEQ ID NO: 527 - protein, 646 aa, Triticum aestivum
MSELGCVHNAFSYSIVLKSLCDNSMSQRGLDMLQMMAKEGGVCFPNVVAYSTVIHGFFKEGETGKACNLFHEMMQQGLVPDVVTYNSIIDALCKARAMDKAELVLRQMVANGAQPDTVTYNCMINGYATSGRLKESAKMFREMKSRGLMPDIVTCNSFLSSLCKHGRSKEAAEFFDSMTAKGHKPDIVSCRILLHGYATEGCFADMIDLFNSVGSNGIAADCRVFKILINRYAKRGMTDEAMLIFTEMRGQGVSPNVVTYSIVIAALSRKLSRMGRLTDAMDKFDQMVALGVQPDRSIYQSLIQGFFMHGGLVKAKELVSQMINKGIPRPDIVFFNSVINSMCKEGRVMDAHDIFDLVIDIGERPDDISFNSLIDGYCLVGNMDKAFKILDAMEVGVEPDVITYNTLVNGYCRNGRIDDGLALFREMPHKRIKPDTVTYDIILNGLFHSGSTVAARKMFHEMIESGITVSIPTYGIIIAGFCRNNCAEEAIDLFHKLSAMNVKFDIAIHNTMINAIFKVGRREEAKDLFAAISPSGLVPTESTYAVMITNLLEDGVVEEADNMFSSMEKSGIIPSSRLLNCIIRMLLEKGEIAKAGNYLSKVDGKSILLEASTTLLMLSLFSKKGKYREDMKLLPAKYQFFMDLVD

SEQ ID NO: 528 - protein, 646 aa, Triticum aestivum
MSELGCVHNAFSYSIVLKSLCDNSMSQRGLDMLQMMAKEGGVCFPNVVAYSTVIHGFFKEGETGKACNLFHEMMQQGLVPDVVTYNSIIDALCKARAMDKAELVLRQMVANGAQSDTVTYNCMINGYATSGRLKESAKMFREMKSRGLMPDIVTCNSFLSSLCKHGRSKEAAEFFDSMTAKGHKPDIVSCRILLHGYATEGCFADMIDLFNSVGSNGIAADCRVFKILINRYAKRGMTDEAMLIFTEMRGQGVSPNVVTYSIVIAALSRKLSRMGRLTDAMDKFDQMVALGVQPDRSIYQSLIQGFFMHGGLVKAKELVSQMINKGIPRPDIVFFNSVINSMCKEGRVMDAHDIFDLVIDIGERPDDISFNSLIDGYCLVGNMDKAFKILDAMEVGVEPDVITYNTLVNGYCRNGRIDDGLALFREMPHKRIKPDTVTYDIILNGLFHSGSTVAARKMFHEMIESGITVSIPTYGIIIAGFCRNNCAEEAIDLFHKLSAMNVKFDIAIHNTMINAIFKVGRREEAKDLFAAISPSGLVPTESTYAVMITNLLEDGVVEEADNMFSSMEKSGIIPSSRLLNCIIRMLLEKGEIAKAGNYLSKVDGKSILLEASTTLLMLSLFSKKGKYREDMKLLPAKYQFFMDLVD

SEQ ID NO: 529 - protein, 646 aa, Triticum aestivum; identical to SEQ ID NO: 527

SEQ ID NO: 530 - protein, 638 aa, Triticum aestivum
MSRRFVPLDRRILERNIKARYHAGDIGTQDALHLFDELLHVAGPSSVRAINCLLTVVGRDCPALGVSLFNRVARAKVPPHNVTYGILVDCCCRAGRLDLGHAAMGRVIKLGFTAEAIVNFSHLLKAICAEKKTSYAMDIVLRIMPEFNCIPNIFSYNILFKGLCNEKRSQEALDLIQVMVEDGGCCQPDVVTYNTVIDGLLKEGEVGKAYSLFSEMLRQGVSPNVVTCNSIISGMCKLHAMDKAEEVLQQMLDRGILPDVATYNSLIHGYYSLGQCEEVDRIFKEMTTNGVQPDIVTYNIQMDYLCKNGRCAEARKIFDSMISLGQKPTVTTYNILLHGYAMERSFHDMNCLIELMDDNGISPDHYGYNILISAYAKEKMVDDVLHIFTKMRQQGLNPDVANYGAVINLLSSIGRMDDAMSQYNQMINEGLAPDIIVFNSLISGFCSCGKWEKVHELFSEMLDRGICPNTVFFTTIMDRLCKNGRVMEAQDLFDLMVHMGVKPDVWTYNTLIGGYLFIGKMDEVSKLLDNMCSIGLKPNVFTYGILIDGYSKNGSIDDALVVIREMLDGVKPSIITFNIMIGVLLKGSRMEEAKDLFDGIWAKGLVPDVVTYSLMIQKLIEEGSLTVVNFFHQASKLL

SEQ ID NO: 531 - protein, 638 aa, Triticum aestivum; identical to SEQ ID NO: 530

SEQ ID NO: 532 - protein, 638 aa, Triticum aestivum; identical to SEQ ID NO: 530

SEQ ID NO: 533 - protein, 615 aa, Triticum aestivum
MRILKYETVITSTKYLNTKQIQNIQQNCMMHACTNTTQSHALRVKCMVRSGPANRIPVAPSPHLRPPSSRRWTRPVGRRRRALGLTVAAGRSERHHRTRPSSFHQSKVLVVASRIHRCRNWTATMSRLQVRSFSSPVSSRANDLLSELQGHLGFRTLRPELAHQLFDQMMRQPVPVSARALNGLFAALARAPPSAACTDGPALAIDLFNRMARAGRRRVIALTSHTYSILIECCCRVRRPDLGPSFFAHLLKTGVTANIVIYSGLIKCLCDLKCTEEALDVLLHRMPNNISDAISYSVILKSFCDSGRSQLALDLLHMMAKKGADHSPDVLAYNMVIDGFFKEGEVSKTFDLFHEMIQQGPVPDVVTYSFFINALCKARAMDKAEVVLRSMIHNGVQPDAVTYNSLIQGFLTSGQLKEAFRLLKLMTRQGVIPDVVTCNSVMDYLCKHGRVKEAAEIFYSTAVKGRKPDIVSYSIMLHGYAIEGSLVKMIDLCEMMARDGVVPDLSCFNILIKAYAKYGRMDVAMLFFEDMLKQGVKPNELTYLTVISAFCKMGRMDDAMEKFSEMINMGVPLDTEVYMCMVEGYLNLGDSMKAKEFITKMKNRDIHHKPWKGNR

SEQ ID NO: 534 - protein, 602 aa, Triticum aestivum
MPRFSSTTSMSSLRLRLRLHARHSSSASQPSRSQGWDPHAAFAAATERARSGNLTPEDAHNLFDELLRQGNPVLERPLNNLLAALARAPASSACGDGPALAVALFSRISQGARLRVAHPTACTYSILMDCCYRARCPDLSLAFFGRLLRTGLKADQFVFSTLLKGLCHAKRSDEALDVLLHRMPELGCTPYVVAYNTVIHGFFREGQVGKACNLFHEMRQQGVTPDVVTYNSVIDALCKAKAMDKAEYFLGQMVDDGVVPDNVTYNSLIHGYSSSGHWKEAVRVFKEMTSRRVTADVHTYNMFMTFLCKHGRSKEAAGIFDTMAMKGLKPNIVSYSTLLHGYATEGCLIDMINLFNSMERDCILPNCHIFSILINAYAKSGKLDKAMLIFNEMQKQGLSPDAFTYLPVIDAFCKKGRLDDAMIKFNQMIDTGVRPDTAVYTSLIQGFCTHGDLVKAKELVTEMMNKGIPPPDIKFFHSIMQNLCTEGRVTKAWDILGLIAHIGMRPNVVTFSVLVGGYCLVRKMADASKVFDDMVSYGLEPCNIMYGILINGYCKNRRIDDGLILFKEMLHKGLKPTTFNYNVILNGLFLAGQTVAAKEKFD

SEQ ID NO: 535 - protein, 602 aa, Triticum aestivum; identical to SEQ ID NO: 534

SEQ ID NO: 536 - protein, 602 aa, Triticum aestivum; identical to SEQ ID NO: 534

SEQ ID NO: 537 - protein, 602 aa, Triticum aestivum; identical to SEQ ID NO: 534

SEQ ID NO: 538 - protein, 602 aa, Triticum aestivum; identical to SEQ ID NO: 534

SEQ ID NO: 539 - protein, 602 aa, Triticum aestivum; identical to SEQ ID NO: 534

SEQ ID NO: 540 - protein, 618 aa, Triticum aestivum
MSQRALDLLQMMAKEGGGCSPNVVAYSTVIRGFFKEGETGKACNLFHEMMQQGVEPSVWTYSSIIDALCKARAMDKAELVLQQMVNKGVQPNNVTYNCMIHGYSTSGQSKEAAKLLREMKSRDLIPDIVTRNSFLASLCKHGRSKEAAEFLDSMTAKGHKPDIVSYRILLHGYASEGCFADMIDLFNSMESNGIAADCHVFNILINGYAKRGMTEEAMLIFTEMRGQGVSPDVVTYSIVIAALSRMGRLTDAIEKFNEMTALEVQPDTTVYHSLIQGCCIDGDLVKAKELMFEMMNGGIPRPNIVFFNSVINSLCKEGRVMDAHDVLDLVIGIGERPDVITFNSLIDGYCLVGKTDKAFKILDVMKSVGVESDVVTYSALLDGYFKNRRIDDALTLFREMPRKRIKPGTVTYGIMLDGLFRAGRTVAAKKMFHEMNESGTTVDISTYNIILGGLCRNKCADEAITLFQKLRAMNVKLNIKILNTMINAMYTVQRKEEAKDLFSAMSANGLVPNESTYAVMIRNLLKDGAVEDADNMFSSMDNSGIIPSSCLINDIIRMLLEKGEIAKAGNYLSKVDGKRISLEASTTSLMLSLFSRKGKHQEDIKLLPAKYQFFDGFG

SEQ ID NO: 541 - protein, 618 aa, Triticum aestivum; identical to SEQ ID NO: 540

SEQ ID NO: 542 - protein, 618 aa, Triticum aestivum; identical to SEQ ID NO: 540

SEQ ID NO: 543 - protein, 618 aa, Triticum aestivum; identical to SEQ ID NO: 540

SEQ ID NO: 544 - protein, 618 aa, Triticum aestivum; identical to SEQ ID NO: 540

SEQ ID NO: 545 - protein, 618 aa, Triticum aestivum; identical to SEQ ID NO: 540

SEQ ID NO: 546 - protein, 320 aa, Triticum aestivum
MDYLCKNGRCAEARKIFDSMVSLGQKPTVTTYSILLHGYAMERSFHDMNCLIDLMVGNGIAPNHFIYNILISAYAKEEMVGEVMHIFTKMRQQGLNPDVANYEAVINLLSSIGRMDDAMSQYNQMITEGLLPGIILFSQLISGFRTCGKWEKVHELFSEMLDRGIYPNTVFLNTIMDHLCKNGRVMEAQDLFDLMVHMGVKPDVCTYSTLIGGYLFVGQMDEVSKLLDNMVSIGLKPNVITYTILIDGYCKNGRIDDALVVFREMLAGKVKPCIITFNIMIGALLKGGRKEEAKDLFDGIWAKGLVPTVVTYSLMIQKLI

SEQ ID NO: 547 - protein, 621 aa, Triticum aestivum
MSRRVVPVGRRILEQNIKARYHARDIGTEDALHLFDELLQDAQPSSIHAINCLLTIIRRDCPALGVSLFNRIARAKVAPDIITYGILVQCCCRAGRLDLGHAAMGHIIKLGFAAESIVNFNHLLKAICAEKKTSYAMDIVLRLMPEFNCIPNIFSYNILFKGLCNEKRSQEALELIQIMVEDGGCCRPDVVTYNTVVDGLLKEGEVGKAYSLFSEMLHRGISPNAVTYSSIICGMCRLHLMDKAEEVLQQMFDREILPDVATYTSLIHGYYSLGQCEEVDRIFKEMSRNGVQPDIVTYNIQMDYLCKNGRCAEARKIFDSMVSLGQKPTVTTYSILLHGYAMERSFHDMNCLIDLMVGNGIAPNHFIYNILISAYAKEEMVGEVMHIFTKMRQQGLNPDVANYEAVINLLSSIGRMDDAMSQYNQMITEGLLPGIILFSQLISGFRTCGKWEKVHELFSEMLDRGIYPNTVFFNTIMDHLCKNGRVMEAQDLFDLMVHMGVKPDVCTYSTLIGGYLFVGQMDEVSKLLDNMVSIGLKPNVITYTILIDGYCKNGRIDDALVVFREMLAGKVKPCIITFNIMIGALLKGGRKEEAKDLFDGIWAKGLVPTVVTYSLMIQKLI

SEQ ID NO: 548 - protein, 621 aa, Triticum aestivum; identical to SEQ ID NO: 547

SEQ ID NO: 549 - protein, 622 aa, Triticum aestivum
MRLWTFCFTGCLSLAAPLTWWRDVVAYNTVIHGFFKEGQVGKACNLFHGMAQQGVAPNLVTYNSVIDALCKAKAMDKAEYFLGQMVDDGVVPDNVTYNSLIHGYSSSGHWKEAVRVFKEMTSRRVKPNVHTHNMFMTFLCKHGRSKEAAGIFDTMAMKGLKHNNVSYAILLHGYATEGCLVDMINLFNSMERDCILPDCRIFSILINAYAKSGKLDKAMLIFNKMQKQGVSPNAVTYSTVIDAFCKKGQLDDAMIKFNQMIDTGVRQGTAVYGSLIQGFCTHCDLVKAKELLTEMMNKGMLPPDIAFFNSIMQNLCTEGRVIEARDVLGLIAHIGVRPDVCTFNILIGGYCLVGKMEHASKIFDDMMSYGLEPSNITYGILINGYCKNRRIDDGLILFKEMLHKGLKPTTFNYNVILDGLFLAGRTVAAKEKFDEMVESGVSVCIGTYSIVLGGLCRNNCFSEAIMLFQKLRAMNMKFNIRIVNIMIDAFFRVQRKQEAKDLFAAIPANGLVANVVTYSITMTNLIKEGSVEEANTLFLSMEKSGCTANAWMLNHTIRRLLERGEIVKAGNYMSKVDAKSYSLEAKTVSLLISLFSGKGKYREHIGLLPTKYQFREEAATVE

SEQ ID NO: 550 - protein, 622 aa, Triticum aestivum; identical to SEQ ID NO: 549

SEQ ID NO: 551 - protein, 622 aa, Triticum aestivum
MRLWTFCFTGCLSLAAPLTWWRDVVAYNTVIHGFFKEGQVGKACNLFHGMAQQGVAPNLVTYNSVIDALCKAKAMDKAEYFLGQMVDDGVVPDNVTYNSLIHGYSSSGHWKEAVRVFKEMTSRRVKPNVHTHNMFMTFLCKHGRSKEAAGIFDTMAMKGLKHNNVSYAILLHGYATEGCLVDMINLFNSMERDCILPDCRIFSILINAYAKSGKLDKAMLIFNKMQKQGVSPNAVTYSTVIDAFCKKGQLDDAMIKFNQMIDTGVRQGTAVYGSLIQGFCTHCDLVKAKELLTEMMNKGMLPPDIAFFNSIMQNLCTEGRVIEARDVLGLIAHIGVRPDVCTFNILIGGYCLVGKMEHASKIFDDMMSYGLEPSNITYGILINGYCKNRRIDDGLILFKEMLHKGLKPTTFNYNVILDGLFLAGRTVAAKEKFDEMVESGVSVCIGTYSIVLGGLCRNNCFSEAIMLFQKLRAMNMKFNIRIVNIMIDAFFRVQRKQEAKDLFAAIPANGLVANVVTYSITMTNLIKEGSVEEADTLFLSMEKSGCTANAWMLNHTIRRLLERGEIVKAGNYMSKVDAKSYSLEAKTVSLLISLFSGKGKYREHIGLLPTKYQFREEAATVE

SEQ ID NO: 552 - protein, 622 aa, Triticum aestivum; identical to SEQ ID NO: 551

SEQ ID NO: 553 - protein, 622 aa, Triticum aestivum
MRLWTFCFTGCLSLAAPLTWWRDVVAYNTVIHGFFKEGQVGKVCNLFHGMAQQGVAPNLVTYNSVIDALCKAKAMDKAEYFLGQMVDDGVVPDNVTYNSLIHGYSSSGHWKEAVRVFKEMTSRRVTADVHTHNMFMAFLCKHGRSKEAAGIFDTMAIKGLKPDNVSYAILLHGCATEGCLVDMINLFNSMATDCILPNCHIFNILINAYAKSGKLDKAMLIFNVMQKQGVSPDGVTYSTVIHAFCKMGSLDIAMDKFNQMVDMGVRPNAIVYHSLIQGFCTHGDLVKAKELVAEMRNKAMRPPDIKFFHSIMQNLCTEGRVIEARDILDLIVRIGMRPDVPIFNLLIGGYCLVRKMADASKIFDDMVSYGLEPSNITYGILINGYCKNRRIDDGLILFKEMLPKGLKPTTFNYNVILDGLFLAGRTVAAKEKFDEMVESGVSVCIGTYSIVLGGLCRNNCSGEAITLFQKLSTMDVKFNIIIVNIMIDAFYKVQRNQEAKDLFAAVSANGLVANVFTYTIMMKNLIKEGSVEEADDLFLSMEKSGCTADSYMLNLIVRMLLGKGEIVKAGNYISKIDAKSYSLEAKTVSLLISLFSGKGKYREHIGLLPAKYRFREEAATVV

SEQ ID NO: 554 - protein, 622 aa, Triticum aestivum; identical to SEQ ID NO: 553

SEQ ID NO: 555 - protein, 625 aa, Triticum aestivum
MICLHKRSKAIQSSPVQYAHSARPASPRRCPSLHLLRRRSSSFTPTSPPSRSWSPHAAFAAATESVRAGTLSPQDAHQLFDQLLRQSTPVPGQALNGFLAGLARARDTDACRDGPSLALTLFNRVYGEEAGPRVAPPTVHTYNILMNCCCRVGRSDLGLAYFSRLLRTGLKANEVTASTVLKCLCCAKPADEAVNVLLHRMSVLGCVPNSFSYNIVLKSLCDDSRSEQALDLLQVMAKGDDCPPPNVLSYSTLIHGFFKEGEVGKACNLFHEMMRQGVVPDVVTYSSIIDALCKAGAMDKAELFLRQMVDSGVPPNKVTYTSMIHGYSTLDWWKEATKMFREMTSRGLIPDIVSWNSFMDSLCKHGRSKEAAEIFDSMAAKGHRPNIVSYTILLHGYANEGSFADMMSLFNSMEGDGIVANCYVFNILINAYAKRRMMDEAVLILTEMRGQGLSPDVFTYSTLISALCKMGRLADAMDKFSQMIGTGVQPDTVVYQSLIQGFCTHGELVYEMMNKGIPCPNIAFFSSIVDSLCKEGRVMDAHHIFDLVKDIGERPDIIMFNTLIDGYCLVGEMGKAFMVLDVMTSAGIEPDAITYSTLVSGYCKSGRIDGGLILFREMLHKKCYI

SEQ ID NO: 556 - protein, 625 aa, Triticum aestivum; identical to SEQ ID NO: 555

SEQ ID NO: 557 - protein, 571 aa, Triticum aestivum
MPQLGVQPDVVTYTSIMDALSKSGAMDKAEVLLRQMVDQGIEPNIRTYSCLIHGYSTFGQWKEALRVFKEMASLGVVPDVVTLSSLIDSLCRHRRTKQAREIFDSMAAKGLKPNIVSYSTMLNGYVKEGSFEDMTDLFNSMVRNGIVPNHHIFNILINAYAKRGLMDEAMHMFEVMRQQGVNPDVFGYQIIMDSLCKMGKMDAALDKFNQMVNQGVSPNKAVYQCLVLGSCSHGDFVKAKELISEAVNRGLCSNSVFFYPVINDLCKEGKVKEAHDMFDFILGIGQRPDVIMYTSLMDGYCLVGKVEEALRVLDAMKSAGLQPDVFTYGTLLNGYCKIGRIADGLSLFREMSLSGVKPTTIMYNIILDGLFRSGRTDSAKEEFDTMIESGIPVGIDTCTIVLSGLCKNNCTDEAIELFKKLCAMNVKFDVIILNTMISSMFKTRRIEEAKDLFATISTIGLVPSVVTYSVMMTNFIKEGSLAEADDMFLAMEKASCAPNSILLNQVVRALLKKGAVVKAATYLAKLDAKQLSVEASTISLIVFLFSGEGKLREHVELLPVKYQPPESSADS

SEQ ID NO: 558 - protein, 571 aa, Triticum aestivum; identical to SEQ ID NO: 557

SEQ ID NO: 559 - protein, 607 aa, Triticum aestivum
MAKDRGGCFPDVVAYNTVIHGFFKEGETGKACNLFHEMIHQGVEPDVVTYNSVVDALCKARAMDKAELVLRQMVADGAQPNAVTYNCMINGYATSGRLKEAAKMFREMKSRGLIPDIFTCNSLMTYLCKHGRSKEAAEFFYSMTAKGHKPDIVSYCILLHGYATEGCFPDMIDVFNSMENNGIAADFHVFNILIDAYAKRGMMDEAMLISSKMQERRVNPDIVTYSSIIAGLSRLGRLTEAMEKFNQMIALGVQPNKVVYHALIQGFCIDGDLAKAKQLVSEMMNRGIPRPNISFFSSLIKSLCQEGRVMDAHDIFDLVIDMGERPDDILFNSLIDGYCLVRKMDKALKVLDVMESVGVEPDVITYNTLVNGYCRNGRIGDGLTLFREMPRKRIKPDTNSYCVIMDGLFRSGRTVSGREMFHEMIESGTTVSISTYNVILGGLCGNNCADEAIALFQKLGSMNVKFSIAIVNTMIDAMYRVGRREEAKELFAGISASGLVPNESTYGVMIMNLLKDGAVEDANNVFSSMDKSGIVPSSRLLNDIIRMLLEKDEIAKAGNYLSKVDGKSISLEASTTSLMLSLFSREGKYREDMKLLPAKYQFFDGFC

SEQ ID NO: 560 - protein, 607 aa, Triticum aestivum
MAKDRGGCFPDVVAYNTVIHGFFKEGETGKACNLFHEMIHQGVEPDVVTYNSVVDALCKARAMDKAELVLRQMVADGAQPNAVTYNCMINGYATSGRLKEAAKMFREMKSRGLIPDIFTCNSLMTYLCKHGRSKEAAEFFYSMTAKGHKPDIVSYCILLHGYATEGCFPDMIDVFNSMENNGIAADFHVFNILIDAYAKRGMMDEAMLISSKMQERRVNPDIVTYSSIIAGLSRLGRLTEAMEKFNQMIALGVQPNKVVYHALIQGFCIDGDLAKAKQLVSEMMNRGIPRPNISFFSSLIKSLCQEGRVMDAHDIFDLVIDMGERPDDILFNSLIDGYCLVRKMDKALKVLDVMESVGVEPDVITYNTLVNGYCRNGRIGDGLTLFREMPRKRIKPDTNSYCVIMDGLFRSGRTVSGREMFHEMIESGTTVSISTYNVILGGLCGNNCADEAIALFQKLGSMNVKFSIAIVNTMIDAMYRVGRREEAKELFAGISASGLVPNESTYGVMIMNLLKDGAVEDANNVFSSMDKSGIVPSSRLLNDIIRMLLEKGEIAKAGNYLSKVDGKSISLEASTTSLMLSLFSREGKYREDMKLLPAKYQFFDGFC

SEQ ID NO: 561 - protein, 607 aa, Triticum aestivum; identical to SEQ ID NO: 560

SEQ ID NO: 562 - protein, 607 aa, Triticum aestivum
MAKDRGGCFPDVVAYNTVIHGFFKEGETGKACNLFHEMIHQGVEPDVVTYNSVFDALCKARAMDKAELVLRQMVADGAQPNAVTYNCMINGYATSGRLKEAAKMFREMKSRGLIPDIFTCNSLMTYLCKHGRSKEAAEFFYSMTAKGHKPDIVSYCILLHGYATEGCFPDMIDVFNSMENNGIAADFHVFNILIDAYAKRGMMDEAMLISSKMQERRVNPDIVTYSSIIAGLSRLGRLTEAMEKFNQMIALGVQPNKVVYHALIQGFCIDGDLAKAKQLVSEMMNRGIPRPNISFFSSLIKSLCQEGRVMDAHDIFDLVIDMGERPDDILFNSLIDGYCLVRKMDKALKVLDVMESVGVEPDVITYNTLVNGYCRNGRIGDGLTLFREMPRKRIKPDTNSYCVIMDGLFRSGRTVSGREMFHEMIESGTTVSISTYNVILGGLCGNNCADEAIALFQKLGSMNVKFSIAIVNTMIDAMYRVGRREEAKELFAGISASGLVPNESTYGVMIMNLLKDGAVEDANNVFSSMDKSGIVPSSRLLNDIIRMLLEKDEIAKAGNYLSKVDGKSISLEASTTSLMLSLFSREGKYREDMKLLPAKYQFFDGFC

SEQ ID NO: 563 - protein, 607 aa, Triticum aestivum; identical to SEQ ID NO: 562

SEQ ID NO: 564 - protein, 607 aa, Triticum aestivum; identical to SEQ ID NO: 562

SEQ ID NO: 565 - protein, 567 aa, Triticum aestivum
MIHQGVEPDVVTYNSVVDALCKARAMDKAEVVLQQMVDKGVQPNIVTYTCMINGYSTTGRLKEAAKMFREMKSRGLIPDIVTCNSLMTSLCKHGRSKEAAEVFYSMTAKGHKPDIVSYRILLHGYATEGCFPDMIDVFNSMENNGIAADCHVFNILIDAYTKRGMIDEAMLISSKMQERRVNPDIVTYSSIIAGLSRLGRLTEAMEKFNQMIALGVQPNKVVYHALIQGFCIDGDLAKAKQLVSEMMNKGIPRPNISFFSSVIKSLCQEGRVMDAHDIFDLVIDMGERPDAILFNSLIDGYCLVRKMDKALKVLDVMESVGVEPDVITYNTLVNGYCRNGRIDDGLTLFREMPRKRIKPDTISYCVIMDGLFRSGRTVSAREMFHEMIENGTTVSISTYNVILGGLCRNNCADEAIALFQKLGSMNVKFSIAIVNTMIDAMYRVGRREEAKELFAGISARGLVPNVSTYGVLIMNLLKDGAVEDANNVFSSMDKSGIVPSSRLMNDIIRLLLEKGEIAKAGYYLSKVDGKSISLEASTTSLMFSLFSRKGKYMKDMNLLPAKYQFFD

SEQ ID NO: 566 - protein, 445 aa, Triticum aestivum
MIHQGVEPDVVTYNSVVDALCKARAMDKAEVVLQQMVDKGVQPNIVTYTCMINGYSTSGRLKEAAKMFREMKSRGLIPDIVTCNSLMTSLCKHGRSKEAAEVFYSMTAKGHKPDIVSYRILLHGYATEGCFPDMIDVFNSMENNGIAADCHVFNILIDAYTKRGMIDEAMLISSKMQERRVNPDIVTYSSIIAGLSRLGRLTEAMEKFNQMIALGVQPNKVVYHALIQGFCIDGDLAKAKQLVSEMMNKGIPRPNISFFSSVIKSLCQEGRVMDAHDIFDLVIDMGERPDAILFNSLIDGYCLVRKMDKALKVLDVMESVGVEPDVITYNTLVNGYCRNGRIDDGLTLFREMPRKRIKPDTISYCVIMDGLFRSGRTVSAREMFHEMIENGTTVSISTYNVILGGLCRNNCADEAIALFQKLGSMNVKFSIAIVNTMIDAMYRVG

SEQ ID NO: 567 - protein, 567 aa, Triticum aestivum
MIHQGVEPDVVTYNSVVDALCKARAMDKAEVVLQQMVDKGVQPNIVTYTCMINGYSTSGRLKEAAKMFREMKSRGLIPDIVTCNSLMTSLCKHGRSKEAAEVFYSMTAKGHKPDIVSYRILLHGYATEGCFPDMIDVFNSMENNGIAADCHVFNILIDAYTKRGMIDEAMLISSKMQERRVNPDIVTYSSIIAGLSRLGRLTEAMEKFNQMIALGVQPNKVVYHALIQGFCIDGDLAKAKQLVSEMMNKGIPRPNISFFSSVIKSLCQEGRVMDAHDIFDLVIDMGERPDAILFNSLIDGYCLVRKMDKALKVLDVMESVGVEPDVITYNTLVNGYCRNGRIDDGLTLFREMPRKRIKPDTISYCVIMDGLFRSGRTVSAREMFHEMIENGTTVSISTYNVILGGLCRNNCADEAIALFQKLGSMNVKFSIAIVNTMIDAMYRVGRREEAKELFAGISARGLVPNVSTYGVMIMNLLKDGAVEDANNVFSSMDKSGIVPSSRLMNDIIRLLLEKGEIAKAGYYLSKVDGKSISLEASTTSSMFSLFSRKGKYMKDMNLLPAKYQFFD

SEQ ID NO: 568 - protein, 567 aa, Triticum aestivum; identical to SEQ ID NO: 567

SEQ ID NO: 569 - protein, 567 aa, Triticum aestivum
MIHQGVEPDVVTYNSVVDALCKARAMDKAEVVLQQMVNKGVQPNIVTYTCMINGYSTSGRLKEAAKMFREMKSRGLIPDIVTCNSLMTSLCKHGRSKEAAEVFYSMTAKGHKPDIVSYRILLHGYATEGCFPDMIDVFNSMENNGIAADCHVFNILIDAYTKRGMIDEAMLISSKMQERRVNPDIVTYSSIIAGLSRLGRLTEAMEKFNQMIALGVQPNKVVYHALIQGFCIDGDLAKAKQLVSEMMNKGIPRPNISFFSSVIKSLCQEGRVMDAHDIFDLVIDMGERPDAILFNSLIDGYCLVRKMDKALKVLDVMESVGVEPDVITYNTLVNGYCRNGRIDDGLTLFREMPRKRIKPDTISYCVIMDGLFRSGRTVSAREMFHEMIENGTTVSISTYNVILGGLCRNNCADKAIALFQKLGSMNVKFSIAIVNTMIDAMYRVGRREEAKELFAGISARGLVPNVSTYGVMIMNLLKDGAVEDANNVFSSMDKSGIVPSSRLMNDIIRLLLEKGEIAKAGYYLSKVDGKSISLEASTTSSMFSLFSRKGKYMKDMNLLPAKYQFFD

SEQ ID NO: 570 - protein, 567 aa, Triticum aestivum; identical to SEQ ID NO: 567

SEQ ID NO: 571 - protein, 385 aa, Triticum aestivum
MMQQGVVPDVVTYNSIIDALCKARAMGKAELFLGQMVDNSVRPDNVTYTAVIHGYSTLGQWKKATKMFREMTRRGLEPNTVTWNSFMASLCKHGRSKEAAEIFHSMAAKGHKPDVVSYCVLLQGYATEGCFADMVDLYNSMARNGIVPNRQVFNILIDAYAKRGMTDEATLIFTEMRGQGLSPDVCTYSTLISALSRTGRLADAMDRFSQMISIGIQPDAVVYQALIQGYCTVGDLVKAKGLVSEMMNRGIPPTDIVFFNSIMSSLCKEGRVTNAHSILDFVIHFGERPSIITFNLLIDGYCLVGKMKKAFRVLDTMASVGIGPDDISYSAIINGCFKNGRIDDGLTIFREMLKKVTPTTVTYNIILGGLFCAGQTVAAQKMFMR

SEQ ID NO: 572 - protein, 385 aa, Triticum aestivum; identical to SEQ ID NO: 571

SEQ ID NO: 573 - protein, 569 aa, Triticum aestivum
MMQQGVVPDVVTYNSIIDALCKARAMGKAELFLGQMVDNSVRPDNVTYTAVIHGYSTLGQWKKATKMFREMTSRGLEPNTVTWNSFMDSLCKHGRSKEAAEIFHSMAAKGHKPDVVSYRVLLQGYATEGCFADMVDLYNSMARNGIVPNRQVFNILIDAYAKRGMTDEATLIFTEMRGQGLSPDVCTYSTLISALSRTGRLADAMDRFSQMISIGIQPDAVVYQALIQGYCTVGDLVKAKGLVSEMMNRGIPPTDIVFFNSIMSSLCKEGRVTNAHSILDFVIHFGERPSIITFNFLIDGYCLVGKMKKAFGVLDTMASVGIGLDDISYSAIINGCFKNGRIDDGLTIFREMLKKVTPTTVTYNIILGGLFCAGQTVAAQKMFHEMIESGITVSSSTYRTILGGLCRNSCEDEAITLFQKLGAMNVKLDIAILNTMINAMFKVQRREEAIDLFAAVSSSGLVPNASTYGVMIKNLLREGSVEKAENMFSLMEKSGCAPDSRLINDIIRILLQKGEIVKAGNYMSKVDGRRISLEARTTSLLIRLFSSEGKYRGQINLLPVKYQNFDGFS

SEQ ID NO: 574 - protein, 569 aa, Triticum aestivum; identical to SEQ ID NO: 573

SEQ ID NO: 575 - protein, 569 aa, Triticum aestivum; identical to SEQ ID NO: 573

SEQ ID NO: 576 - protein, 569 aa, Triticum aestivum
MMQQGVVPDVVTYNSIIDALCKVRAMGKAELFLGQMVDNSVRPDNVTYTAVIHGYSTLGQWKKATKMFREMTSRGLEPNTVTWNSFMDSLCKHGRSKEAAEIFHSMAAKGHKPDVVSYRVLLQGYATEGCFADMVDLYNSMARNGIVPNRQVFNILIDAYAKRGMTDEATLIFTEMRGQGLSPDVCTYSTLISALSRTGRLADAMDRFSQMISIGIQPDAVVYQALIQGYCTVGDLVKAKGLVSEMMNRGIPPTDIVFFNSIMSSLCKEGRVTNAHSILDFVIHFGERPSIITFNFLIDGYCLVGKMKKAFGVLDTMASVGIGLDDISYSAIINGCFKNGRIDDGLTIFREMLKKVTPTTVTYNIILGGLFCAGQTVAAQKMFHEMIESGITVSSSTYRTILGGLCRNSCEDEAITLFQKLGAMNVKLDIAILNTMINAMFKVQRREEAIDLFAAVSSSGLVPNASTYGVMIKNLLREGSVEKAENMFSLMEKSGCAPDSRLINDIIRILLQKGEIVKAGNYMSKVDGRRISLEARTTSLLIRLFSSEGKYRGQINLLPVKYQNFDGFS

SEQ ID NO: 577 - protein, 608 aa, Triticum aestivum
MMAKEGGGCFPNVVAYNTVIHGFLKEGKTGKACNLFHEMMQLGLVPDVVTYNSIVDALCKARAMDKAEVVLHQMIGKGAQPDTVTYNCMIHGYSTSGRLKEAVKMFREMKSRGLAPNIVTCGSLMTSLCKHGRSKEAREIFDSMTAKGHRANVVSYSILLHGYANEGCFADMIDLFNSMKSNGIAADCRVFTILIDAYAKRGMMDDAMHIFTEMWEKGVSPDVVTYSTVIAALSRMGRLTDAMDKFNQMISMGVQPNTVVYHTLIQGSCMHGDLIKAKELVSEMMNKGIPRPSIAFFGSIINRLCKDGRVMDAHDIFDLVIDIGERPSVITFNSLVDGYCLVGKMDKAFGMLNAMESVGVEPDIVTYSTLLDGYFKNGRINDGLTLFREMPLKRIKPDTVTYGIMLDGCFRAGRTVAARTMFHEMIESGITVDIPTYNIVLRGLCRNNCTDEAIALFQKLGAMSMKFNIAILNTMINAIYKVRRREEANNLFAAISASGLVPNQSTYAVMIINLLKDGAVEHASNMFSSMEKSGIVPSSRLINGIIRLLLENGEIAKAGIYLSKVDGNSISLEASTTSLMLSLFSRKGKYQEDMKLLPAKYQFFGEFG

SEQ ID NO: 578 - protein, 348 aa, Triticum aestivum
MMAKEGGGCFPNVVAYNTVIHGFLKEGKTGKACNLFHEMMQLGLVPDVVTYNSIVDALCKARAMDKAEVVLHQMIGKGAQPDTVTYNCMIHGYSTSGRLKEAVKMFREMKSRGLAPNIVTCGSLMTSLCKHGRSKEAREIFDSMTAKGHRANVVSYSILLHGYANEGCFADMIDLFNSMKSNGIAADCRVFTILIDAYAKRGMMDDAMHIFTEMWEKGVSPDVVTYSTVIAALSRMGRLTDAMDKFNQMISMGVQPNTVVYHTLIQGSCMHGDLIKAKELVSEMMNKGIPRPSIAFFGSIINRLCKDGRVMDAHDIFDLVIDIGERPSVITFKCNDTRPLCTYCLLLN

SEQ ID NO: 579 - protein, 608 aa, Triticum aestivum; identical to SEQ ID NO: 577

SEQ ID NO: 580 - protein, 608 aa, Triticum aestivum; identical to SEQ ID NO: 577

SEQ ID NO: 581 - protein, 265 aa, Triticum aestivum
MSWNQLVLSLMLLHIIHLLMAIVKVEGSMMVSFYSEKCRVRELNLTVTYGIILAGLFRAWRTIAARTMFHEMIESGITVDIVTYNIILTGLCRNNCIDEAIALFQKLGVMSVKFNIAIINTMIDAMYKVRRREEASDLFAAISASGLVPNESTYAVMIINLLKDGAVEEADNMFSSMEKSGIVPSSRLLNRIIRMLLEKGETAKAGNYLSKVDGKGISLEASTTSLMLSLFSREGKYREDVKLLPAKYQFFDGFVDFAQDSAQEA

SEQ ID NO: 582 - protein, 606 aa, Triticum aestivum
MWAYNTVIHGFFKEGETGKACNLFHEMVRQGIVPDVVTYNSIIDALCKARAMDKAELVLQQMVADGAQPNEVTYNSMINGYASSGRLKGTTKMFREMKRRGLIPDNFTCNSFLASLCKHGRSKEAAEFFDSMTAKGHKPDIVSYCTLLHGYASEGCFADMIDLFNSMESNVIAADCRVFTILIVAYAKRGMMDEAMLVSSKMQERGVNPNIFTYSSIIAGLSRMGRLTEAMEKFNQMIALGVQPDKVVYLSLIQGFCLDGDLAKVKQLVSEMMNRGIPHSGIPFFGSVIKNLCQEGRVMDAHEIFDLVIDMGERPDDILFNSLIDGYCLVGKMDKALKVLDVMESVGVEPDVITYNTLVNGYCKSGRIDDGLVLFREMPSKRVKPDTVTYGIILAGLFRAWRTIAARTMFHEMIESGITVDIVTYNIILTGLCRNNCIDEAIALFQKLGVMSVKFNIAIINTMIDAMYKVRRREEAGDLFAAISASGLVPNESTYAVMIINLLKDGAVEEADNMFSSMEKSGIVPSSRLLNRIIRMLLEKGETAKAGNYLSKVDGKGISLEASTTSLMLSLFSREGKYREDVKLLPAKYQFFYGFVDFAQDSAQEA

SEQ ID NO: 583 - protein, 410 aa, Triticum aestivum
MWAYNTVIHGFFKEGETGKACNLFHEMVRQGIVPDVVTYNSIIDALCKARAMDKAELVLQQMVADGAQPNEVTYNSMINGYASSGRLKGTTKMFREMKRRGLIPDNFTCNSFLASLCKHGRSKEAAEFFDSMTAKGHKPDIVSYCTLLHGYASEGCFADMIDLFNSMESNGIAADCRVFTILIVAYAKRGMMDEAMLVSSKMQERGVNPNIFTYSSIIAGLSRMGRLTEAMEKFNQMIALGVQPDKVVYLSLIQGFCLDGDLAKVKQLVSEMMNRGIPHSDIPFFGSVIKNLCQEGRVMDAHEIFDLVIDMGERPDDILFNSLIDGYCLVGKMDKALKVLDVMESVGVEPDVITYNTLVNGYCKSGRIDDGLVLFREMPSKRVKPDCYIWHHTGRVVSCLENYCCKDNVP

SEQ ID NO: 584 - protein, 606 aa, Triticum aestivum
MWAYNTVIHGFFKEGETGKACNLFHEMVRQGIVPDVVTYNSIIDALCKARAMDKAELVLQQMVADGAQPNEVTYNSMINGYASSGRLKGTTKMFREMKRRGLIPDNFTCNSFLASLCKHGRSKEAAEFFDSMTAKGHKPDIVSYCTLLHGYASEGCFADMIDLFNSMESNGIAADCRVFTILIVAYAKRGMMDEAMLVSSKMQERGVNPNIFTYSSIIAGLSRMGRLTEAMEKFNQMIALGVQPDKVVYLSLIQGFCLDGDLAKVKQLVSEMMNRGIPHSDIPFFGSVIKNLCQEGRVMDAHEIFDLVIDMGERPDDILFNSLIDGYCLVGKMDKALKVLDVMESVGVEPDVITYNTLVNGYCKSGRIDDGLVLFREMPSKRVKPDTVTYGIILAGLFRAWRTIAARTMFHEMIESGITVDIVTYNIILTGLCRNNCIDEAIALFQKLGVMSGKFNIAIINTMIDAMYKVRRREEASDLFAAISASGLVPNESTYAVMIINLLKDGAVEEADNMFSSMEKSGIVPSSRLLNRIIRMLLEKGETAKAGNYLSKVDGKGISLEASTTSLMLSLFSREGKYREDVKLLPAKYQFFDGFVDFAQDSAQEA

SEQ ID NO: 585 - protein, 606 aa, Triticum aestivum; identical to SEQ ID NO: 582

SEQ ID NO: 586 - protein, 606 aa, Triticum aestivum; identical to SEQ ID NO: 582

SEQ ID NO: 587 - protein, 606 aa, Triticum aestivum
MWAYNTVIHGFFKEGETGKACNLFHEMVRQGIVPDVVTYNSIIDALCKARAMDKAELVLQQMVADGAQPNEVTYNSMINGYASSGRLKGTTKMFREMKRRGLIPDNFTCNSFLASLCKHGRSKEAAEFFDSMTAKGHKPDIVSYCTLLHGYASEGCFADMIDLFNSMESNGIAADCRVFTILIVAYAKRGMMDEAMLVSSKMQERGVNPNIFTYSSIIAGLSRMGRLTEAMEKFNQMIALGVQPDKVVYLSLVQGFCLDGDLAKVKQLVSEMMNRGIPHSDIPFFGSVIKNLCQEGRVMDAHEIFDLVIDMGERPDDILFNSLIDGYCLVGKMDKALKVLDVMESVGVEPDVITYNTLVNGYCKSGRIDDGLVLFREMPSKRVKPDTVTYGIILAGLFRAWRTIAARTMFHEMIESGITVDIVTYNIILTGLCRNNCIDEAIALFQKLGVMSGKFNIAIINTMIDAMYKVRRREEASDLFAAISASGLVPNESTYAVMIINLLKDGAVEEADNMFSSMEKSGIVPRSRLLNRIIRMLLEKGETAKAGNYLSKVDGKGISLEASTTSLMLSLFSREGKYREDVKLLPAKYQFFDGFVDFAQDSAQEA

SEQ ID NO: 588 - protein, 535 aa, Triticum aestivum
MPRLRLRRFSTAPMFHLLRRSSSSTTTSPPSRSWSPHAAFAAATERIRAGTLSREDAHHLFDELLRQATPVPSRSLNGLLAALARVPAPAACIRDGPALALGLFNRVCRDEAGARVAPPTVFTYGILMHCCCCAHRPDLGLALFGRFLRTGLKTNEIIATTFLKCLCYAKRTDEALNVLLHRMSELGCVPDAISYNIVLKSLCEDSMSQRALDLLQMMAKEGGGCSPNVVAYSTVIHGFFKEGETGKACNLFHEMMQQDVEPNVWTYSSIIDALCNARAMDKAELVLQQMVNKGVQPNNVTYNCMIHGYSTSGRWKEAAKLFREMKSRGLIPDTSTCNALMTYHCKHGRSKEAAEFFDAMTAKGHRDVISYCILLHGYANEGCFADMIDLFNSMESNGFVADCHVFTILIDAYAKRGMMDEAMLIFTEMREKGVSPNVVTYSTVIAALCRLGRLSDAMDRFNEMTDMGVQPNTAVYHSLIQGFCMHGDLVKVKEFVSEMMNKGIPRPDIAFFTSVINSLCKEGRVMNAQVSLTWL

SEQ ID NO: 589 - protein, 535 aa, Triticum aestivum; identical to SEQ ID NO: 588

SEQ ID NO: 590 - protein, 535 aa, Triticum aestivum; identical to SEQ ID NO: 588

SEQ ID NO: 591 - protein, 519 aa, Triticum aestivum
MATASFEERTTSPPSRSWSPHAAIAAATERIRAGTLSREDAHHLFDELLRQATPVPSRSLNGLLAALARVPAPAACIRDGPALALGLFNRVCRDEAGARVAPPTVFTYGILMHCCCCAHRPDLGLALFGRFLRTGLKTNEIIATTFLKCLCYAKRTDEALNVLLHRMSELGCVPDAISYNIVLKSLCEDSMSQRALDLLQMMAKEGGGCSPNVVAYSTVIHGFFKEGETGKACNLFHEMMQQDVEPNVWTYSSIIDALCNARAMDKAELVLQQMVNKGVQPNNVTYNCMIHGYSTSGRWKEAAKLFREMKSRGLIPDTSTCNALMTYHCKHGRSKEAAEFFDAMTAKGHRDVISYCILLHGYANEGCFADMIDLFNSMESNGFVADCHVFTILIDAYAKRGMMDEAMLIFTEMREKGVSPNVVTYSTVIAALCRLGRLSDAMDRFNEMTDMGVQPNTAVYHSLIQGFCMHGDLVKVKEFVSEMMNKGIPRPDIAFFTSVINSLCKEGRVMNAQVSLTWL

SEQ ID NO: 592 - protein, 596 aa, Triticum aestivum
MWWHIAVIHGFFKEGETSKACNLFHEMMQQGVEPSVWTYSSIIDALCKARAMDKAELVLQQMVNKGVQPNNVTYNCMIHGYSTSGRWKEAAKLFREMKSQGLIPDTFTCNALMTYLCKHGRSKEGAEISDAMTAKGHKPDIVSYSILLHGYANEGCFADMIDLFNSMERNGIAADCHVFSILINGYAKCGMTDEAMLIFTEMWEKGVSPDVVTYSTVIAALSRMGRLTDAMEKFNQMIAMGIQPNTAIYHSLIQGFCIDGDLVKAKQLVSEMMNRGIPRPNIVFFNLVINSLCKEGRVMDAHDVLDLVIGIGERPNVITFNSLIDGYCLVGKMDKAFKILDVMKSVGVESDVVTYSALLDGYSKNRRIDDALTLFREMPHKRIKSDTVTYGIVLDGLFHAGRTVAAMKMFHEMIKSGTTVSIYTYSIILGGLCRNNCVDDAIALFQKLRSMNVKFNIEILNTMINAMYKVQRKEEAKDLFTTISANGLVPSESTYAVMIRNLLKDGAVEDADNMFSSMDNSGIVPSSHLINDIIRMLLEKGEIAKAGNYLSKVDGKSISLEASTTSLMLSLFSRKGKHQEDIKLLPAKYQIFDGFS

SEQ ID NO: 593 - protein, 586 aa, Triticum aestivum
MSNLRLLRRSSSSMSTTTSPPSRSWSPHSAFAAATERVRARTLSQDDAHHLFDELLRQATPVHERSLNGFLAALARATSSAACIRDGPALAIALFNRVCREQAGPRVAPLTVHTYGILMECCCRAGHPELGLAIFSRLLRTGLKTNEIVGSTFLKCLSYAKRTDEALNVLLHRMPELGCVPNAFSYSIVLKSLCNNSMSQRALDLLQRMAKEGGGCFLNVVTHSTVIHGFFKEGEIGKACTLFHEMMQQGVVPNVWTYNSIIDALCKARAMDKAELVLRQMVAKGAQPDTVTYNCLINGYATSGRLKEAAKMFREMKSRGLTPNIVTCGSLTTSLCKHGRSKEAREIFDSMTSKGHRANVVSYSILLHGYANEGCFADMIYLFNSMKSNGIAADCRVFNILINGYAKRGMMDEAVLIFTEMREKGVSPDVVTYTTVIAALSRMGRLTDAVDEFDEMIAMGVQPSIPVYQSLIQGFCIDGDLVKAKELVSEMMNKGIPCPNIVFFNSVINSLCKEERVMDAHDIFDLVIDIGERPDTITFSSLIDGYCLVGKMDKAFGMLNAMELVGVEPDCNAFDAAISPTCRSTT

SEQ ID NO: 594 - protein, 584 aa, Triticum aestivum
MSRRFVPVGRHILEQNIKARYHAGDIGTEDALHLFDELLQVAGRSSIHAINCLLTVVGRDCPALGVSLFNRVARSKVAPCSITYAILVDCCCRAGRQDLGHTAMGHVIKMGFLADAIITFSHLLKAICAENKTSYAMDIVLQEMDISSIFDRIFQEMSRNGVQPDIVTYTIQMDYLCKSGRCTEARKIFDSMISLGQKPTVTTYSILLHGYAMEKSFHDMLCLIDLMVGNGIVPDHYVYNILISAYAKEEMVGEVMHIFTKMRQQGLNPDAVSYGTVIDLLSRIGRMDDAMSLFNQMITEGLAPGIIVFNHLISGFCTCGKWEKVHELFSEMLDCGICPDTVFFNTVMDRLCKNGRVTEAQDLFDLMVHMGVKPDVCTYNTLMGGYLFVGKMDEVSKLLDNMVSIGMEPDVITYNILIDGYSKNGRIDDALVVFREMLDTKGKPSVISFNIMIGALLKCGRKAEAKDLFDGIWANGLVPDIVTYSLMIQKLIEEGSLQESDDLFVSMEKNGCAANSRMLNAIVRSLLQKGEVPRAGTYLSKIDERSFILEASTASLLTALASRGKGQEYKELLPEKYSELLIEA

SEQ ID NO: 595 - protein, 584 aa, Triticum aestivum; identical to SEQ ID NO: 594

SEQ ID NO: 596 - protein, 584 aa, Triticum aestivum; identical to SEQ ID NO: 594

SEQ ID NO: 597 - protein, 545 aa, Triticum aestivum
  misc_feature (479)..(479): Xaa can be any naturally occurring amino acid
MSRRFPPVGRRILERRIEERYSARDIGTDDTLNLFDELIQVAGPSSVRAINCLLTVVGRDCPALGVSLFNRVARAKVPPHNITYGILVDCCCRAGRLDLGHAAMGHVIKLGFTAEAIVNFSHLLKAICAVKKTSYAMDIVLRVMPEFNCTPNIFSYSILFKGLCNERRSQEALELINIMVEDGGSCQPDVVTYNTVIDGLLKEGEVDQAYSLFSEMLRQGVSPNVVTCNSIISGMCKLHAMDKAEEVLQQMLDRRILPDVATYNSLIHGYYSLGQCEEVDRIFKEMTTNGVQPDVVTYNIQMDYLCKNGRCAEARKIFDSMISLGQKPTVTTYNILLHGYAMERSFHDMNCLIELMDDNGISPDHYGYNILISAYAKEKMVDDVLHIFTKMRQQGLNPDVANYGAVINLLSSIGRMDDAMSQYNQMINEGLAPDIIVFNSLISGFCSCGKWEKVHELFSEMLDRGICPNTVFFTTIMDXLCKNGRVIEAQDVFDLMVHMGVKPDVRSHVTLMHGYFADGKMDEMRKLLENMCSIGLKLMLSPIAY

SEQ ID NO: 598 - protein, 511 aa, Triticum aestivum
MSRRFPPVGRRILERRIEERYSARDIGTDDTLNLFDELIQVAGPSSVRAINCLLTVVGRDCPALGVSLFNRVARAKVPPHNITYGILVDCCCRAGRLDLGHAAMGHVIKLGFTAEAIVNFSHLLKAICAVKKTSYAMDIVLRVMPEFNCTPNIFSYSILFKGLCNERRSQEALELINIMVEDGGSCQPDVVTYNTVIDGLLKEGEVDQAYSLFSEMLRQGVSPNVVTCNSIISGMCKLHAMDKAEEVLQQMLDRRILPDVATYNSLIHGYYSLGQCEEVDRIFKEMTTNGVQPDVVTYNIQMDYLCKNGRCAEARKIFDSMISLGQKPTVTTYNILLHGYAMERSFHDMNCLIELMDDNGISPDHYGYNILISAYAKEKMVDDVLHIFTKMRQQGLNPDVANYGAVINLLSSIGRMDDAMSQYNQMINEGLAPDIIVFNSLISGFCSCGKWEKVHELFSEMLDRGICPNTVFFTTIMDRLCKNGRVMEAQDLFQADRRRRPGNVSQVEGDP

SEQ ID NO: 599 - protein, 593 aa, Triticum aestivum
  misc_feature (508)..(508): Xaa can be any naturally occurring amino acid
MVSIGEHARPPNSAFLLPNPSSCPGCAGAVGGERRRRPLGPLPLPDSSRSISGAMSRRAVPAGRRILEQNIKARYRAGAIGTDDALHLFDELLQVAWPSSIAAINCLLIVVGRDCPVLAVSLFNHIARAKVAPHNITYGILVDCCSRAGRLDLGFAAMGHIVKMGFVARSVVSFSHLLRAVCAKKKTSYRMDIMLQIMPELNCIPDVYSYSILFKGLCNEKRSQEALELIHVMVEHGGSCQPNLVSYNTVIDGLLKEGEVGKAYSLFCEMVQSGILANIVTYNSIISGMCKVHAMDKAEKVLQQMFDREILPDTATYTTLIRGYYSSGQCKEVERVFEHMSINGVQPNMITCNIQMDYLCKSGRCAEARKIFDSMVSLGQKPSVTTYSILLHGYVMEKSFHDMHCLLDLMVENGISPDHHVYNILISAYAKEEMASEVMHIFTKMRQQGLNPSVADYGAVINLLSSIGRMDDAMSQFNQMIAEGLAPDIIVFNPLISGFCTCGKWEKXHELFSEMLNRGTYHDTVFFTTIMDRLCKNGRVMEAQDMFDLMVHVGVKPNVHTYATLMHGYFFVRKMDEVRKLLGNILSIGSKPD

SEQ ID NO: 600 - protein, 593 aa, Triticum aestivum
MVSIGEHARPPNSAFLLPNPSSCPGCAGAVGGERRRRPLGPLPLPDSSRSISGAMSRRAVPAGRRILEQNIKARYRAGAIGTDDALHLFDELLQVAWPSSIAAINCLLIVVGRDCPVLAVSLFNHIARAKVAPHNITYGILVDCCSRAGRLDLGFAAMGHIVKMGFVARSVVSFSHLLRAVCAKKKTSYRMDIMLQIMPELNCIPDVYSYSILFKGLCNEKRSQEALELIHVMVEHGGSCQPNLVSYNTVIDGLLKEGEVGKAYSLFCEMVQSGILANIVTYNSIISGMCKVHAMDKAEKVLQQMFDREILPDTATYTTLIRGYYSSGQCKEVERVFEHMSINGVQPNMITCNIQMDYLCKSGRCAEARKIFDSMVSLGQKPSVTTYSILLHGYVMEKSFHDMHCLLDLMVENGISPDHHVYNILISAYAKEEMASEVMHIFTKMRQQGLNPSVADYGAVINLLSSIGRMDDAMSQFNQMIAEGLAPDIIVFNPLISGFCTCGKWEKFHELFSEMLNRGTYHDTVFFTTIMDRLCKNGRVMEAQDMFDLMVHVGVKPNVHTYATLMHGYFFVRKMDEVRKLLGNILSIGSKPD

SEQ ID NO: 601 - protein, 593 aa, Triticum aestivum; identical to SEQ ID NO: 600

SEQ ID NO: 602 - protein, 254 aa, Triticum aestivum
  misc_feature (44)..(44): Xaa can be any naturally occurring amino acid
MSINGVQPNMITYNIQMDYLCKSGRCAEARKIFDSMVSLGQKPXVTTYSILLHGYVMEKSFHDMHCLLDLMVENGISPDHHVYNILISAYAKEEMASEVMHIFTKMRQQGLNPSVADYGAVINLLSSIGRMDDAMSQFNQMIAEGLAPDIIVFNPLISGFCTCGKWEKVHELFSEMLNRGTYPDTVFFTTIMDRLCKNGRVMEAQDMFDLMVHVGVKPNVHTYATLMHGYFFVRKMDEVRKLLGNMLSIGSKPD

SEQ ID NO: 603 - protein, 593 aa, Triticum aestivum; identical to SEQ ID NO: 600

SEQ ID NO: 604 - protein, 593 aa, Triticum aestivum
MVSIGEHARPPNSAFLLPNPSSCLGCVGAVGGERHRRPLGPLRLPDSSRSIGGAMSRRTVPAGRRILEQNIKARYRAGAIGTDDALHLFDELLQVAWPSSIAAINCLLIVVGRDCPALAVSLFNHIARAKVAPHNITYGILVDCCSHAGRLDLGFAAMGHIVKTVFAAGSIVSFSHLLRAVCAEKKTSYGMDIVLRIMPELNCIPDVYSYSMLFKGLCNEKRSQEALEMIHVMVEHGGSCQPNLVSYNAVIDGLLKEGEVGKAYILFCEMVQSGILANIVTYNSIISGMCKVHAMDKAEKVLQQMFDREILPDTATYTSLIHGCYSSGQCKEVERVFEHMSINGVQPNMITYNIQMDYLCKSGRCAEARKIFDSMVSLGQKPSVTTYSILLHGYVMEKSFHDMHCLLDLMVENGISPDHHVYNILISAYAKEEMASEVMHIFTKMRQQGLNPSVADYGAVINLHSSIGRMDDAMPQFNQMIAEGLAPDIIVFNPLISGFCTCGKWEKVHELFSEMLNRGTYHDTVFFTTIMDRLCKNGRVMEAQDMFDLMVHVGVKPNVHTYATLMHGYFFVRKMDEVRKLLGNMLSIGSKPD

SEQ ID NO: 605 - protein, 593 aa, Triticum aestivum
MVSIGEHARPPNSAFLLPNPSSCPGCVGAVGGERHRRPLGPLPLPDSSRSIGGAMSRRAVPAGRRILEQNIKARYRAGAIGTDDALHLFDELLQVAWPSSIAAINCLLIVVGRDCPALAVSLFNHIARAKVAPHNITYGILVDCCSRAGRLDLGFAAMGHIVKTGFAAGSVVSFSHLLRAVCAEKKTSYGMDIVLRIMPELNCIPDVYSYSILFKGLCNEKRSQEALELIHVMVEHGGSCQPNLVSYNTVIDGLLKEGEVGKAYSLFCEMVQSGILANIVTYNSIISGMCKVHAMDKAEKVLQQMFDREILPDTATYTSLIHGYYSSGQCKEVERVFEHMSINGVQPNMITYNIQMDYLCKSGRCAEARKIFDSMVSLGQKPSVTTYSILLHGYVMEKSFHDMHCLLDFMVENGISPDHHVYNILISAYAKEEMASEVMHIFTKMRQQGLNPSVADYGAVINLLSSIGRMDDAMSQFNQMIAEGLAPDIIVFNPLISGFCTCGKWEKVHELFSEMLNRGTYHDTVFFTTIMDRLCKNGRVMESQDMFDLMVHVGVKPNVHTYATLMHGYFFVRKMDEVRKLVGNMLSIGSKPD

SEQ ID NO: 606 - protein, 593 aa, Triticum aestivum
MVSIGEHARPPNSAFLLPNPSSCLGCVGAVGGERHRRPLGPLRLPDSSRSIGGAMSRRAVPAGRRILEQNIKARYRAGAIGTDDALHLFDELLQVAWPSSIAAINCLLIVVGRDCPALAVSLFNHIARAKVAPHNITYGILVDCCSHAGRLDLGFAAMGHIVKTVFAAGSIVSFSHLLRAVCAEKKTSYGMDIVLRIMPELNCIPDVYSYSMLFKGLCNEKRSQEALEMIHVMVEHGGSCQPNLVSYNAVIDGLLKEGEVGKAYILFCEMVQSGILANIVTYNSIISGMCKVHAMDKAEKVLQQMFDREILPDTATYTSLIHGCYSSGQCKEVERVFEHMSINGVQPNMITYNIQMDYLCKSGRCAEARKIFDSMVSLGQKPSVTTYSILLHGYVMEKSFHDMHCLLDLMVENGISPDHHVYNILISAYAKEEMASEVMHIFTKMRQQGLNPSVADYGAVINLHSSIGRMDDAMPQFNQMIAEGLAPDIIVFNPLISGFCTCGKWEKVHELFSEMLNRGTYPDTVFFTTIMDRLCKNGRVMEAQDMFDLMVHVGVKPNVHTYATLMHGYFFVRKMDEVRKLLGNMLSIGSKPD

SEQ ID NO: 607 - protein, 593 aa, Triticum aestivum
MVSIGEHARPPNSAFLLPNPSSCPGCVGAVGGERHRRPLGPLPLPDSSRSIGGAMSRRAVPAGRRILEQNIKARYRAGAIGTDDALHLFDELLQVAWPSSIAAINCLLIVVGRDCPALAVSLFNHIARAKVAPHNITYGILVDCCSHAGRLDLGFAAMGHIVKTVFATGSIVSFSHLLRAVCAEKKTSYGMDIVLRIMPELNCIPDVYSYSMLFKGLCNEKRSQEALEMIHVMVEHGGSCQPNLVSYNAIIDGLLKEGEVGKAYSLFCEMVQSGILANIVTYNSIISGMCKVHAMDKAEKVLQQMFDREILPDTATYTSLIHGCYSSGQCKEVERVFEHMSINGVQPNMITYNIQMDYLCKSGRCTEARKIFDSMVSLGQKPSVTTYSILLHGYVMEKSFHDMHCLLDLMVENGISPDHHVYNILISAYAKEEMASEVMHIFTKMRRQGLNPSVADYGAVINLLSSIGRMDDAMPQFNQMIAEVLAPDIIVFNPLISGFCTCGKWEKVHELFSEMLNRGTYPDTVFFTTIMDRLCKNGRVMEAQDMFDLMVHVGVKPNVHTYATLMHGYFFVRKMDEVRKLLGNMLSIGSKPD

SEQ ID NO: 608 - protein, 593 aa, Triticum aestivum
MVSIGEHARPPNSTFLLPNPSSCPGCAGAVGGERHRRPLGPLPLPDSSRSIGGAMSRRAVPAGRRILEQNIKARYRAGAIGTDDALHLFDELLQVAWPSSIAAINCLLIVVGRDCPTLAVSLFNHIARAKVAPHNITYGILVDCCSRAGRLDLGFAAMGHIVKTGFAAGSVVSFSHLLRAVCAEKKTSYGMDIVLRIMPELNCIPDVYSYSILFKGLCNEKRSQEALELIHVMVEHGGSCQPNLVSYNTVIDGLLKEGEVGKAYSLFCEMVQSGILANIVTYNSIISGMCKVHAMDKAEKVLQQMFDREILPDTATYTSLIHGYYSSGQCKEVERVFEHMSINGVQPNMITYNIQMDYLCKSGRCAEARKIFDSMVSLGQKPFVTTYSILLHGYVMEKSFHDMHCLLDLMVENGISPDHHVYNILISAYAKEEMASEVMHIFTKMRQQGLNPSVADYGAVINLLSSIGRMDDAMSQFNQMIAEGLAPDIIVFNPLISGFCTCGKWEKVHELFSEMLNRGTYPDTVFFTTIMDRLCKNGRVMEAQDMFDLMVHVGVKPNVHTYATLMHGYFFVRKMDEVRKLLGNMLSIGSKPD

SEQ ID NO: 609 - protein, 593 aa, Triticum aestivum
  misc_feature (423)..(423): Xaa can be any naturally occurring amino acid
MVSIGEHARPPNSAFLLPNPSSCPGCAGAVGGERRRRPLGPLPLPDSSRSIGGAMSRRAVPAGRRILEQNIKARYRAGAIGTDDALHLFDELLQVAWPSSIAAINCLLIGVGRDCPALAVSLFNHIARAKVAPHNITYGILVDCCSRAGRLDLGFAAMGHIVKTGFAAGSVVSFSHLLRAVCAKKKTSYGMDIVLRIMPELNCIPDVYSYGILFKGLCNEKRSQEALELIHVMVEHGGSCQPNLVSYNTVIDGLLKEGEVGKAYILFCEMVQSGILANLVTYNSIISGMCKVHAMDKAEKVLQQMFDREILPDTATYTSLIHGYYSSGQCKEVERVFEHMSINGVQPNMITYNIQMDYLCKSGRCAEARKIFDSMVSLGQKPSVTTYSILLHGYVMEKSFHDMHCLLDLMVENGISPDHHVYXILISAYAKEEMASEVMHIFTKMRQQGLNPSVADYGAVINLLSSIGRMDDAMSQFNQMIAEGLAPDIIVFNPLISGFCTCGKWEKVHELFSEMLNRGTYPDTVFFTTIMDRLCKNGRVMEAQDKFDLMVHMGVKPNVHTYATLMHRYFFVMKMDEVRKLLGNMLSIGSKPD

SEQ ID NO: 610 - protein, 593 aa, Triticum aestivum
MVSIGEHARPPNSAFLLPNPSSCPGCVGAVGGERHRRPLGPLPLPDSSRSIGGAMSRRAVPAGRRILEQNIKARYRAGAIGTDDALHLFDELLQVAWPSSIATINCLLIVVGRDCPALAVSLFNHIARANVAPHNITYGILVDCCSRAGRLDLGFAAMGHIVKTGFAAGSVISFSHLLRAVCAEKKTSYGMDIVLRIMPELNCIPDVYSYSILFKGLCNEKRSQEALELIHVMVEHGGSCQPNLVSYNTVIDGLLKEGEVGKAYSLFCEMVQSGILANIVTYNSIISGMCKVHAMDKAEKVLQQMFDREILPDTATYTSLIHGYYSSGQCKEVERVFEHMSINGVQPNMITYNIQMDYLCKSGRCAEARKIFDSMVSLGQKPSVTTYSILLHGYVMEKSFHDMHCLLDFMVENGISPDHHVYNILISAYAKEEMASEVMHIFTKMRQQGLNPSVADYGAVINLLSSIGRMDDAMSQFNQMIAEGLAPDIIVFNPLISGFCTCGKWEKVHELFSEMLNRGTYHDTVFFTTIMDRLCKNGRVMESQDMFDLMVHVGVKPNVHTYATLMHGYFFVRKMDEVRKLVGNMLSIGSKPD

SEQ ID NO: 611 - protein, 593 aa, Triticum aestivum
MVSIGEHARPPNSAFLLPNPSSCPGCAGAVGGERRRRPLGPLPLPDSSRSIGGAMSRRAVPAGRCILEQNIKARYRAGAIGTDDALHLFDELLQVAWPSSIAAINCPLIVVGRDCPALAVSLFNHIARAKVAPHNITYGILVDCCSRAGRLDLGFAAMGHIVKTGFAAGSVVSFSHLLRAVCAKKKTSYGMDIVLRIMPELNCIPDVYSYGILFKGLCNEKRSQEALELIHVMVEHGGSCQPNLVSYNTIIDGLLKEGEVGKAYILFCEMVQSGILANIVTYNSIISGMCKVHAMDKAEKVLQQMFDREILPDTATYTSLIHGYYSSGQCKEVERVFEHMSINGVQPNMITYNIQMDYLCKSGRCAEARKIFDSMVSLGQKPSVTTYSILLHGYVMEKSFHDMHCLLDLMVENGISPDHHVYKILISAYAKEEMASEVMHIFTKMRQQGLNPSVADYGAVINLLSSIGRMDDAMSQFNQMIAEGLAPDIIVFNPLISGFCTCGKWQKVHELFSEMLNRGTYPDTVFFTTIMDCICKNGRVMEAQDMFDLMVHVGVKPNVHTYATLMHGYFFVRKMDEVRKLLGNMLSIGSKPD

SEQ ID NO: 612 - protein, 593 aa, Triticum aestivum
MVSIGEHARPPNSAFLLPNPSSCPGCAGAVGGERRRRPLGPLPLPDSSRSIGGAMSRRAVPAGRRILEQNIKARYRAGAIGTDDALHLFDELLQVAWPSSIAAINCLLIVVGRDCPALAVSLFNHIARAKVAPHNITYGILVDCCSRAGRLDLGFAAMGHIVKTGFAAGSVVSFSHLLRAVCAEKKTSYGMDIVLRIMPELNCIPDVYSYSILFKGLCNEKRSQEALELIHVMVEHGGSCQPNLVSYNTVIDGLLKEGEVGKAYSLFCEMVQSGILANIVTYNSIISGMCKVHAMDKAEKVLQQMFDREILPDTATYTSLIHGYYSSGQCKEVERVFEHMSINGVQPNMITYNIQMDYLCKSGRCAEARKIFDSMVSLGQKPFVTTYSILLHGYVMEKSFHDMHCLLDLMVENGISPDHHVYNILISAYAKEEMASEVMHIFTKMRQQGLNPSVADYGAVINLLSSIGRMDDAMSQFNQMIAEGLAPDIIVFNPLISGFCTCGKWEKVHELFSEMLNRGTYPDTVFFTTIMDRLCKNGRVMEAQDMFDLMVHVGVKPNVHTYATLMHGYFFVRKMDEVRKLLGNMLSIGSKPD

SEQ ID NO: 613 - protein, 593 aa, Triticum aestivum
MVSIGEHARPPNSAFLLPNPSSCPGCVGAVGGERHRRPLGPLPLPDSSRSIGGAMSRRAVPAGRRILEQNIKARYRAGAIGTDDALHLFDELLQVAWPSSIAAINCLLIVVGRDCPALAVSLFNHIARAKVAPHNITYGILVDCCSRAGRLDLGFAAMGHIVKTGFAAGSVVSFSHLLRAVCAEKKTSYGMDIVLRIMPELNCIPDVYSYSILFKGLCNEKRSQEVLELIHVMVEHGGSCQPNLVSYNTVIDGLLKEGEVGKAYSLFCEMVQSGILANIVTYNSIISGMCKVHAMDKAEKVLQQMFDREILPDTATYTSLIHGCYSSGQCKEVERVFEHMSINGVQPNMITYNVQMDYLCKSGRCAEARKIFDSMVSLGQKPSVTTYSILLHGYVMEKSFHDMHCLLDLMVENGISPDHHVYNILISAYAKEEMASEVMHIFTKMRQQGLNPSVADYGAVINLLSSIGRMDDAMSQFNQMIAEGLAPDIIVFNPLISGFCTCGKWEKVHELFSEMLNRGTYPDTVFFTTIMDRLCKNGRVMEAQDMFDLMVHVGVKPNVHTYATLMHGYFFVRKMDEVRKLLGNMLSIGSKPD

SEQ ID NO: 614 - protein, 593 aa, Triticum aestivum
MVSIGEHARPPNSAFLLPNPSSCPGCVGAVGGERHRRPLGPLPLPDSSRSIGGAMSRRAVPAGRRILEQNIKARYRAGAIGTDDALHLFDELLQVAWPSSIAAINCLLIVVGRDCPALAVSLFNHIARAKVAPHNITYGILVDCCSHAGRLDLGFAAMGHIVKTVFATGSIVSFSHLLRAVCAEKKTSYGMDIVLRIMPELNCIPDVYSYSMLFKGLCNEKRSQEALEMIHVMVEHGGSCQPNLVSYNAIIDGLLKEGEVGKAYSLFCEMVQSGILANIVTYNSIISGMCKVHAMDKAEKVLQQMFDREILPDTATYTSLIHGCYSSGQCKEVERVFEHMSINGVKPNMITYNIQMDYLCKSGRCTEARKIFDSMVSLGQKPSVTTYSILLHGYVMEKSFHDMHCLLDLMVENGISPDHHVYNILISAYAKEEMASEVMHIFTKMRRQGLNPSVADYGAVINLLSSIGRMDDAMPQFNQMIAEVLAPDIIVFNPLISGFCTCGKWEKVHELFSEMLNRGTYPDTVFFTTIMDRLCKNGRVMEAQDMFDLMVHVGVKPNVHTYATLMHGYFFVRKMDEVRKLLGNMLSIGSKPD

SEQ ID NO: 615 - protein, 593 aa, Triticum aestivum
MVSIGEHARPPNSAFLLPNPSSCPGCAGAVGGERRRRPLGPLPLPDSSRSIGGAMSRRAVPAGRRILEQNIKARYRAGAIGTDDALHLFDELLQVAWPSSIAAINCLLIVVGRDCPALAVSLFNHIARAKVAPHNITYGILVDCCSRAGRLDLGFAAMGHIVKTGFAVGSIVSFSHLLRAVCAKKKTSYGMDIVLRIMPELNCIPDVYSYSILFKGLCNEKRSQEALELIHVMVEHGGSCQPNLVSYNTVIDGLLKEGEVGKAYILFCEMVQSGILANIVTYNSIISGMCKVHAMDKAEKVLQQMFDREILPDTATYTSLIHGYYSSGQCKEVERVFEHMSINGVQPNMITYNIQMDYLCKSGRCAEARKIFDSMVSLGQKPSVTTYSILLHGYVMEKSFHDMHCLLDLMVENGISPDHHVYNILISAYAKEEMASEVMHIFTKMRQQGLNPSVADYGAVINLLSSIGRMDDAMSQFNQMIAEGLAPNIIVFNPLISGFCTCGKWEKVHELFSEMLNRGTYPDTVFFTTIMDRLCKNGRVMEAQDMFDLMVHMGVKPNVHTYATLMHRYFFVRKMDEVRKLLGNMLSIGSKPD

SEQ ID NO: 616 - protein, 593 aa, Triticum aestivum
MVSIGEHARPPNSAFLLPNPSSCPGCAGAVGGERRRRPLGPLPLPDSSRSIGGAMSRRAVPAGRRILEQNIKARYRAGAIGTDDALHLFDELLQVAWPSSIAAINCLLIGVGRDCPALAVSLFNHIARAKVAPHNITYGILVDCCSRAGRLDLGFAAMGHIVKTGFAAGSVVSFSHLLRAVCAKKKTSYGMDIVLRIMPELNCIPDVYSYGILFKGLCNEKRSQEALELIHVMVEHGGSCQPNLVSYNTVIDGLLKEGEVGKAYILFCEMVQSGILANLVTYNSIISGMCKVHAMDKAEKVLQQMFDREILPDTATYTSLIHGYYSSGQCKEVERVFEHMSINGVQPNMITYNIQMDYLCKSGRCAEARKIFDSMVSLGQKPSVTTYSILLHGYVMEKSFHDMHCLLDLMVENGISPDHHVYKILISAYAKEEMASEVMHIFTKMRQQGLNPSVADYGAVINLLSSIGRMDDAMSQFNQMIAEGLAPDIIVFNPLISGFCTCGKWEKVHELFSEMLNRGTYPDTVFFTTIMDRLCKNGRVMEAQDKFDLMVHMGVKPNVHTYATLMHRYFFVMKMDEVRKLLGNMLSIGSKPD

SEQ ID NO: 617 - protein, 593 aa, Triticum aestivum
MVSIGEHARPPNSAFLLPNPSSCPGCAGAVGGERRRRPLGPLPLPDSSRSIGGAMSRRAVPAGRRILEQNIKARYRAGAIGTDDALHLFDELLQVAWPSSIAAINCLLIVVGRDCPALAVSLFNHIARAKVAPHNITYGILVDCCSRAGRLDLGFAAMGHIVKTGFAAGSVVSFSHLLRAVCAEKKTSYGMDIVLRIMPELNCIPDVYSYSILFKGLCNEKRSQEVLELIHVMVEHGGSCQPNLVSYNTVIDGLLKEGEVGKAYSLFCEMVQSGILANIVTYNSIISGMCKVHAMDKAEKVLQQMFDREILPDTATYTSLIHGCYSSGQCKEVERVFEHMSINGVQPNMITYNVQMDYLCKSGRCAEARKIFDSMVSLGQKPSVTTYSILLHGYVMEKSFHDMHCLLDLMVENGISPDHHVYNILISAYAKEEMASEVMHIFTKMRQQGLNPSVADYGAVINLLSSIGRMDDAMSQFNQMIAEGLAPDIIVFNPLISGFCTCGKWEKVHELFSEMLNRGTYPDTVFFTTIMDRLCKNGRVMEAQDMFDLMVHVGVKPNVHTYATLMHGYFFVRKMDEVRKLLGNMLSIGSKPD

SEQ ID NO: 618 - protein, 593 aa, Triticum aestivum; identical to SEQ ID NO: 611

SEQ ID NO: 619 - protein, 191 aa, Triticum aestivum
MHCLLDLMVENGISPDHHVYNILISAYAKEEMASEVMHIFTKIRQQGLNPSVADYGAVINLLSSIGRMDDAMSQFNQMIAEGLAPDIIVFNPLISGFCTCGKWEKVHELFSEMLNRGTYPDTVFFTTIMDRLCKNGRVMEAQDMFDLMVHVGVKPNVHTYATLMHGYFFVRKMDEVRKLLGNMLSIGSKPD

SEQ ID NO: 620 - protein, 245 aa, Triticum aestivum
  misc_feature (35)..(35): Xaa can be any naturally occurring amino acid
MITYNIQMDYLCKSGRCAEARKIFDSMVSLGQKPXVTTYSILLHGYVMEKSFHDMHCLLDLMVENGISPDHHVYNILISAYAKEEMASEVMHIFTKMRQQGLNPSVADYGAVINLHSSIGRMDDAMPQFNQMIAEGLAPDIIVFNPLISGFCTCGKWEKVHELFSEMLNRGTYPDTVFFTTIMDRLCKNGRVMEAQDMFDLMVHVGVKPNVHTYATLMHGYFFVRKMDEVRKLLGNMLSIGSKPD

SEQ ID NO: 621 - protein, 593 aa, Triticum aestivum
MVSIGEHARPPNSAFLLPNPSSCPGCAGAVGGERRRRPLGPLPLPDSSRSIGGAMSRRAVPAGRRILEQNIKARYRAGAIGTDDALHLFDELLQVAWPSSIAAINCLLIVVGRDCPALAVSLFNHIARAKVAPHNITYGILVDCCSRAGRLDLGFAAMGHIVKTGFAVGSIVSFSHLLRAVCAKKKTSYGMDIVLRIMPELNCIPDVYSYSILFKGLCNEKRSQEALELIHVMVEHGGSCQPNLVSYNTVIDGLLKEGEVGKAYILFCEMVQSGILANIVTYNSIISGMCKVHAMDKAEKVLQQMFDREILPDTATYTSLIHGYYSSGQCKEVERVFEHMSINGVQPNMITYNIQMDYLCKSGRCAEARKIFDSMVSLGQKPSVTTYSILLHGYVMEKSFHDMHCLLDLMVENGISPDHHVYNILISAYAKEEMASEVMHIFTKMRQQGLNPSVADYGAVINLLSSIGRMDDAMSQFNQMIAEGLAPDIIVFNPLISGFCTCGKWEKVHELFSEMLNRGTYPDTVFFTTIMDRLCKNGRVMEAQDMFDLMVHVGVKPNVHTYATLMHGYFFVRKMDEVRKLLGNMLSIGSKPD

SEQ ID NO: 622 - protein, 448 aa, Triticum aestivum
  misc_feature (428)..(428): Xaa can be any naturally occurring amino acid
  misc_feature (436)..(436): Xaa can be any naturally occurring amino acid
MGHIVKTGFAAGSVVSFSHLLRAVCAEKKTSYGMDIVLRIMPELNCIPDVYSYSILFKGLCNEKRSQEVLELIHVMVEHGGSCQPNLVSYNTVIDGLLKEGEVGKAYSLFCEMVQSGILANIVTYNSIISGMCKVHAMDKAEKVLQQMFDREILPDTATYTSLIHGCYSSGQCKEVERVFEHMSINGVQPNMITYNVQMDYLCKSGRCAEARKIFDSMVSLGQKPSVTTYSILLHGYVMEKSFHDMHCLLDLMVENGISPDHHVYNILISAYAKEEMASEVMHIFTKMRQQGLNPSVADYGAVINLLSSIGRMDDAMSQFNQMIAEGLAPDIIVFNPLISGFCTCGKWEKVHELFSEMLNRGTYPDTVFFTTIMDRLCKNGRVMEAQDMFDLMVHVGVKPNVHTYATLMHGYFFVRKMDEVRKLLGNXLSIGSKPXLGVLCFKVSARP

SEQ ID NO: 623 - protein, 593 aa, Triticum aestivum
MVSIGEHARPPNSAFLLPNPSSCPGCAGAVGGERRRRPLGPLPLPDSSRSIGGAMSRRAVPAGRRILEQNIKARYRAGAIGTDDALHLFDELLQVAWPSSIAAINCLLIVVGRDCPALAVSLFNHIARAKVAPHNITYGILVDCCSRAGRLDLGFAAMGHIVKTGFAAGSVVSFSHLLRAVCAEKKTSYGMDIVLRIMPELNCIPDVYSYSILFKGLCNEKRSQEVLELIHVMVEHGGSCQPNLVSYNTVIDGLLKEGEVGKAYSLFCEMVQSGILANIVTYNSIISGMCKVHAMDKAEKVLQQMFDREILPDTATYTSLIHGCYSSGQCKEVERVFEHMSINGVQPNMITYNVQMDYLCKSGRCAEARKIFDSMVSLGQKPSVTTYSILLHGYVMEKSFHDMHCLLDLMVENGISPDHHVYNILISAYAKEEMASEVMHIFTKMRQQGLNPSVADYGAVINLISSIGRMDDAMSQFNQMIAEGLAPDIIVFNPLISGFCTCGKWEKVHELFSEMLNRGTYPDTVFFTTIMDRLCKNGRVMEAQDMFDLMVHVGVKPNVHTYATLMHGYFFVRKMDEVRKLLGNMLSIGSKPD

SEQ ID NO: 624 - protein, 254 aa, Triticum aestivum
MSINGVQPNMITYNIQMDYLCKSGRCAEARKIFDSMVSLGQKPSVTTYSILLHGYVMEKSFHDMHCLLDLMVENGISPDHHVYNILISAYAKEEMASEVMHIFTKMWQQGLNPSVADYGAVINLLSSIGRMDDAMSQFNQMIAEGLAPDIIVFNPLISGFCTCGKWEKVHELFSEMLNRGTYPDTVFFTTIMDRLCKNGRVMEAQDMFDLMVHVGVKPNVHTYATLMHGYFFVRKMDEVRKLLGNMLSIGSKPD

SEQ ID NO: 625 - protein, 593 aa, Triticum aestivum
MVSIGEHARPPNSAFLLPNPSSCPGCASAVGGERRRRPLGPLPLPDSSRSIGGSMSRRAVPAGRRILEQNIKARYRAGAIGTDDAHHLFDELLQVAWPSSIATINCLLIVVGRDCPALAISLFNHIARAKVAPHNITYGILVDCCSRAGRLDLGFTAMGHIVKTGFAAGSVVSFSHLLRAVCAEKKTSYGMDIVLRIMPELNCIPDVYSYSTLFKGLCNEKRSQEALELIHVMVEHGGSCQPNLVSYNTVIDGLLKEGEVGKAYSLFCEMVQSGILANIVTYNSIIFDMCKVHAMDKAEKVLQQMFDREILPDTATYTSLIHGYYSSGQCKEVERVFEHMSINGVQPNMITYNIQMDYLCKSGRCAEARKIFDSMVSLGQKPSVTTYSILLHGYVMEKSFHDMHCLLDLMVENGISPDHHVYNILISAYAKEEMASEVMHIFTKMRQQGLNPSVADYGAVINLLSSIGRMDDAMSQFNQMIAEGLAPDIIVFNPLISGFCTCGKWEKVHELFSEMLNRGTYPDTVFFTTIMDRLCKNGRVMEAQDMFDLMVHVGVKPNVHTYATLMHGYFFVRKMDEVRKLLGNMLSIGSKPD

SEQ ID NO: 626 - protein, 593 aa, Triticum aestivum
MVSIGEHARPPNSAFLLPNPSSCPGCAGAVGGERRRRPLGPLPLPDSSRSIGGAMSRRAVPAGRRILEQNIKARYRAGAIGTDDALHLFDELLQVAWPSSIAAINCLLIVVGRDCPALVVSLFNHIARAKVAPHNITYVILVDCCSRAGRLDLGFAAMGHIVKTGFAAGSVVSFSHLLRAVCAEKKTSYGMDIVLRIMPELNCIPDVYSYSILFKGLCNEKRSQEALELIHVMVEHGGSCQPNLVSYNTVIDGLLKEGEVGKAYSLFCEMVQSGILANIVTYNSIIFGMCKVHAMDKAEKVLQQMFDREILPDTATYTSLIHGYYSSGQCKEVERVFEHMSINGVQPNMITYNIQMDYLCKSGRCAEARKIFDSMVSLGQKPSVTTYSILLHGYVMEKSFHDMHCLLDLMVENGISPDHHVYNILISAYAKEEMASEVMHIFTKMWQQGLNPSVADYGAVINLLSSIGRMDDAMSQFNQMIAEGLAPDIIVFNPLISGFCTCGKWEKVHELFSEMLNRGTYPDTVFFTTIMDRLCKNGRVMEAQDMFDLMVHVGVKPNVHTYATLMHGYFFVRKMDEVRKLLGNMLSIGSKPD

SEQ ID NO: 627 - protein, 593 aa, Triticum aestivum; identical to SEQ ID NO: 614

SEQ ID NO: 628 - protein, 593 aa, Triticum aestivum
MVSIGEHARPPNSAFLLPNPSSCPGCVGAVGGERHRRPLGPLPLPDSSRSIGGAMSRRAVPAGRRILEQNIKARYRAGAIGTDDALHLFDELLQVAWPSSIAAINCLLIVVGRDCPALAVSLFNHIARAKVAPHNITYGILVDCCSHAGRLDLGFAAMGHIVKTVFATGSIVSFSHLLRAVCAEKKTSYGMDIVLRIMPELNCIPDVYSYSMLFKGLCNEKRSQEALELIHVMVEHGGSCQPNLVSYNAIIDGLLKEGEVGKAYSLFCEMVQSGILANIVTYNSIISGMCKVHAMDKAEKVLQQMFDREILPDTATYTSLIHGCYSSGQCKEVERVFEHMSINGVQPNMITYNIQMDYLCKSGRCTEARKIFDSMVSLGQKPSVTTYSILLHGYVMEKSFHDMHCLLDLMVENGISPDHHVYNILISAYAKEEMASEVMHIFTKMRRQGLNPSVADYGAVINLLSSIGRMDDAMPQFNQMIAEVLAPDIIVFNPLISGFCTCGKWEKVHELFSEMLNRGTYPDTVFFTTIMDRLCKNGRVMEAQDMFDLMVHVGVKPNVHTYATLMHGYFFVRKMDEVRKLLGNMLSIGSKPD

SEQ ID NO: 629 - protein, 593 aa, Triticum aestivum; identical to SEQ ID NO: 606

SEQ ID NO: 630 - protein, 593 aa, Triticum aestivum
MVSIGEHARPPNSAFLLPNPSSCPGCVGAVGGERHRRPLGPLPLPDSSRSIGGAMSRRAVPAGRRILEQNIKARYRAGAIGTDDALHLFDELLQVAWPSSIATINCLLIVVGRDCPALAVSLFNHIARAKVAPHNITYGILVDCCSRAGRLDLGFAAMGHIVKTGFAAGSVISFSHLLRAVCAEKKTSYGMDIVLRIMPELNCIPDVYSYSILFKGLCNEKRSQEALELIHVMVEHGGSCQPNLVSYNTVIDGLLKEGEVGKAYSLFCEMVQSGILANIVTYNSIISGMCKVHAMDKAEKVLQQMFDREILPDTATYTSLIHGYYSSGQCKEVERVFEHMSINGVQPNMITYNIQMDYLCKSGRCAEARKIFDSMVSLGQKPSVTTYSILLHGYVMEKSFHDMHCLLDFMVENGISPDHHVYNILISAYAKEEMASEVMHIFTKMRQQGLNPSVADYGAVINLLSSIGRMDDAMSQFNQMIAEGLAPDIIVFNPLISGFCTCGKWEKVHELFSEMLNRGTYHDTVFFTTIMDRLCKNGRVMESQDMFDLMVHVGVKPNVHTYATLMHGYFFVRKMDEVRKLVGNMLSIGSKPD

SEQ ID NO: 631 - protein, 593 aa, Triticum aestivum; identical to SEQ ID NO: 606

SEQ ID NO: 632 - protein, 593 aa, Triticum aestivum
  misc_feature (522)..(522): Xaa can be any naturally occurring amino acid
MVSIGEHARPPNSAFLLPNPSSCPGCVGAVGGERHRRPLGPLPLPDSSRSIGGAMSRRAVPAGRRILEQNIKARYRARAIGTDDALHLFDELLQVAWPSSIAAINCLLIVVGRDCPALAVSLFNHIARAKVAPHNITYGILVDCCSRAGRLDLGFAAMGHIVKTGFAAGSVISFSHLLRAVCAEKKTSYGMDIVLRIMPELNCIPDVYSYSILFKGLCNEKRSQEALELIHVMVEHGGSCQPNLVSYNTVIDGLLKEGEVGKAYSLFCEMVQSGILANIVTYNSIISGMCKVHAMDKAEKVLQQMFDREILPDTATYTSLIHGYYSSGQCKEVERVFEHMSINGVQPNMITYNIQMDYLCKSGRCAEARKIFDSMVSLGQKPSVTTYSILLHGYVMEKSFHDMHCLLDFMVENGISPDHHVYNILISAYAKEEMASEVMHIFTKMRQQGLNPSVADYGAVINLLSSIGRMDDAMSQFNQMIAEGLAPDIIVFNPLISGFCTCGKWEKVHELFSEMLNRGTYXDTVFFTTIMDRLCKNGRVMEAQDMFDLMVHVGVKPNVHTYATLMHGYFFVRKMDEVRKLLGNMLSIGSKPD

SEQ ID NO: 633 - protein, 517 aa, Triticum aestivum
MRPCRTPLLDSTSPLSVLLLDHLHRNRPSPPPSASPPSAFWSPIAAFAAATKRARAGTLSPEDAHHLFDELLRQSNPVPNRFLNSFLAALARAPPSDACGDGPALTVALFNRLCREEAGPCVAPPTIYTYSILMDSCCRVGRPDLGLAVFGRLLKSGFKADQSTASSLLMCLCDVGRTNEAVDVLLHRISELGCEPNVIPYNIVLKSLCDSRRSQQALDLLQMMAQRGCCSPNVVSYNTVIHGLFKEGEVSMACSLFYEMMRQRVMPNVVTYRSMIGALCKVGATDKAKLVLGHMVGNGFRPDKYIWNSFMASLCKQGRSKEAAQLFDYMVAKGHKPDVVTYSTLLHGYATEGCFTDMINLFNSMEGNGIVANSCVFNILIDAYAKRGMMHEAMLIFTEMRERRVSPDIFTYGIIIAALCRMGRLSDAMEKINEMVATGLQPDKAVYYSLIQGFCTHDDLVKAKELVSEMMTKGIPRPNIVFFNSVIASLCKEGRVKDAHGIFDLALNIGERPDLIH

SEQ ID NO: 634 - protein, 517 aa, Triticum aestivum; identical to SEQ ID NO: 633

SEQ ID NO: 635 - protein, 517 aa, Triticum aestivum; identical to SEQ ID NO: 633

SEQ ID NO: 636 - protein, 517 aa, Triticum aestivum; identical to SEQ ID NO: 633

SEQ ID NO: 637 - protein, 517 aa, Triticum aestivum; identical to SEQ ID NO: 633

SEQ ID NO: 638 - protein, 517 aa, Triticum aestivum; identical to SEQ ID NO: 633

SEQ ID NO: 639 - protein, 593 aa, Triticum aestivum
MVSIGEHARPPNSAFLLPNPSSCPGCASAVGGERRRRPLGPLPLPDSSRSIGGSMSRRAVPAGRRILEQNIKARYRAGAIGTDDAHHLFDELLQVAWPSSIATINCLLIVVGRDCPALAISLFNHIARAKVAPHNITYGILVDCCSRAGRLDLGFTAMGHIVKTGFAAGSVVSFSHLLRAVCAEKKTSYGMDIVLRIMPELNCIPDVYSYSTLFKGLCNEKRSQEALELIHVMVEHGGSCQPNLVSYNTVIDGLLKEGEVGKAYSLFCEMVQSGILANIVTYNSIIFDMCKVHAMDKAEKVLQQMFDREILPDTATYTSLIHGYYSSGQCKEVERVFEHMSINGVQPNMITYNIQMDYLCKSGRCAEARKIFDSMVSLGQKPSVTTYSILLHGYVMEKSFHDMHCLLDLMVENGISPDHHVYNILISAYAKEEMASEVMHIFTKMRQQGLNPSVADYGAVINLLSSIGRMDDAMSQFNQMIAEGLAPNIIVFNPLISGFCTCGKWEKVHELFSEMLNRGTYPDTVFFTTIMDRLCKNGRVMEAQDMFDLMVHMGVKPNVHTYATLMHRYFFVRKMDEVRKLLGNMLSIGSKPD

SEQ ID NO: 640 - protein, 436 aa, Triticum aestivum
MGHIVKTGFAAGSVVSFSHLLRAVCAEKKTSYGMDIVLRIMPELNCIPDVYSYNILFKGLCNEKRSQEALELIHVMVEHGGSCQPNLVSYNTVIDGLLKEGEVGKAYSLFCEMVQSGILANIVTYNSIISGMCKVHAMDKAEKVLQQMFDREILPDTATYTSLIHGYYSSGQCKEVERVFEHMSINGVQPNMITYNIQMDYLCKSGRCAEARKIFDSMVSLGQKPSVTTYSILLHGYVMEKSFHDMHCLLDLMVENGISPDHHVYNILISAYAKEEMASEVMHIFTKIRQQGLNPSVADYGAVINLLSSIGRMDDAMSQFNQMIAEGLAPDIIVFNPLISGFCTCGKWEKVHELFSEMLNRGTYPDTVFFTTIMDRLCKNGRVMEAQDMFDLMVHVGVKPNVHTYATLMHGYFFVRKMDEVRKLLGNMLSIGSKPD

SEQ ID NO: 641 - protein, 590 aa, Triticum aestivum
  misc_feature (585)..(585): Xaa can be any naturally occurring amino acid
MVSIGEHARPPNSTFLLPNPSSCPGCAGAVGGERHRRPLGPLPLPDSSRSIGGAMSRRAVPAGRRILEQNIKARYRAGAIGTDDALHLFDELLQVAWPSSIAAINCLLIVVGRDCPALAVSLFNHIARAKVAPHNITYGILVDCCSRAGRLDLGFAAMGHIVKTGFAAGSVVSFSHLLRAVCAEKKTSYGMDIVLRIMPELNCIPDVYSYSILFKGLCNEKRSQEALELIHVMVEHGGSCQPNLVSYNTVIDGLLKEGEVGKAYSLFCEMVQSGILANIVTYNSIISGMCKVHAMDKAEKVLQQMFDREILPDTATYTSLIHGYYSSGQCKEVERVFEHMSINGVQPNMITYNIQMDYLCKSGRCAEARKIFDSMVSLGQKPFVTTYSILLHGYVMEKSFHDMHCLLDLMVENGISPDHHVYNILISAYAKEEMASEVMHIFTKMRQQGLNPSVADYGAVINLLSSIGRMDDAMSQFNQMIAEGLAPDIIVFNPLISGFCTCGKWEKVHELFSEMLNRGTYPDTVFFTTIMDRLCKNGRVMEAQDMFDLMVHVGVKPNVHTYATLMHGYFFVRKMDEVRKLLGNXSKQRF

SEQ ID NO: 642 - protein, 436 aa, Triticum aestivum
  misc_feature (430)..(430): Xaa can be any naturally occurring amino acid
MGHIVKTGFAAGSVVSFSHLLRAVCAEKKTSYGMDIVLRIMPELNCIPDVYSYSILFKGLCNEKRSQEALELIHVMVEHGGSCQPNLVSYNTVIDGLLKEGEVGKAYSLFCEMVQSGILANIVTYNSIISGMCKVHAMDKAEKVLQQMFDREILPDTATYTSLIHGYYSSGQCKEVERVFEHMSINGVQPNMITYNIQMDYLCKSGRCAEARKIFDSMVSLGQKPFVTTYSILLHGYVMEKSFHDMHCLLDLMVENGISPDHHVYNILISAYAKEEMASEVMHIFTKMRQQGLNPSVADYGAVINLLSSIGRMDDAMSQFNQMIAEGLAPDIIVFNPLISGFCTCGKWEKVHELFSEMLNRGTYPDTVFFTTIMDRLCKNGRVMEAQDMFDLMVHVGVKPNVHTYATLMHGYFFVRKMDEVRKLLGNMLXIGSKPD

SEQ ID NO: 643 - protein, 436 aa, Triticum aestivum; identical to SEQ ID NO: 640

SEQ ID NO: 644 - protein, 436 aa, Triticum aestivum; identical to SEQ ID NO: 640

SEQ ID NO: 645 - protein, 567 aa, Triticum aestivum
MSRRLVPVDRRILEQNIKARYHAGDIGTQDALHLFDELLQCAGSSSIRAINYLVTTVGRDCPALGVSLFNRVASANVAPNSITYTILVDCCCRAGRLDLGFAAMGHIIKMGFAADAIVTFSHLLNAICAEKKTSYAMDIVLRIMPMFNCVPNIFSYSILFKGLCNEKRSQEALELIQVMVEHGGSCQPNVVSYSTVIDGLLKEGLVGKAYSLFCEMLQRGISPNAVTCSSIISGMCKAQSMDKSEEVLQQMLDRRILPDVTTYNSLIHGYYSSGRCKEVDRIFQEMSRNGVQPNIVTYNIQMDYLCKSGRCAEARKIFDSMIGLGQKPDVTTYSILLHGSAMEKSFHEMHCLIDLMVGNGISPDHHVYNILMSAYAKEETVGEVMHIFTKMRQQGLNPNVANYGAAVNLLSKIGRMDDAMSQFNQMITEGLAPDIIVFTPLISGFCSCGKWEKVDELFSEMLDRGICPNTVFFNTIMDRLCKNERVMEAQDLFDLMVHMGVKPDVCTYSTLIGGYLFVGKMDEVSKLLDNMVSIGMEPDVITYNILMHLIYLIYIHLVCYVPWTYLI

SEQ ID NO: 646 - protein, 567 aa, Triticum aestivum
MSRRLVPVDRRILEQNIKARYHAGDIGTQDALHLFDELLQCAGSSSIRAINYLVTTVGRDCPALGVSLFNRVASANVAPNSITYTILVDCCCRAGRLDLGFAAMGHIIKMGFAADAIVTFSHLLNAICAEKKTSYAMDIVLRIMPMFNCVPNIFSYSILFKGLCNEKRSQEALELIQVMVEHGGSCQPNVVSYSTVIDGLLKEGLVGKAYSLFCEMLQRGISPNAVTCSSIISGMCKAQSMDKSEEVLQQMLDRRILPDVTTYNSLIHGYYSSGRCKEVDRIFQEMSRNGVQPNIVTYNIQMDYLCKSGRCAEARKIFDSMIGLGQKPDVTTYSILLHGSAMEKSFHEMHCLIDLMVGNGISPDHHVYNILISAYAKEETVGEVMHIFTKMRQQGLNPNVANYGAAVNLLSKIGRMDDAMSQFNQMITEGLAPDIIVFTPLISGFCSCGKWEKVDELFSEMLDRGICPNTVFFNTIMDRLCKNERVMEAQDLFDLMVHMGVKPDVCTYSTLIGGYLFVGKMDEVSKLLDNMVSIGMEPDVITYNILMHLIYLIYIHLVCYVPWTYLI

SEQ ID NO: 647 - protein, 567 aa, Triticum aestivum; identical to SEQ ID NO: 646

SEQ ID NO: 648 - protein, 567 aa, Triticum aestivum; identical to SEQ ID NO: 646

SEQ ID NO: 649 - protein, 567 aa, Triticum aestivum; identical to SEQ ID NO: 645

SEQ ID NO: 650 - protein, 567 aa, Triticum aestivum; identical to SEQ ID NO: 645

SEQ ID NO: 651 - protein, 593 aa, Triticum aestivum
MSGLRLRPRRSSSSTFPMPRSRLRHYASAMPMSSLRPLHRSSSSTTSPARAWSPHAAFAAATERVRAGALRPEDAHTLFDELLRQATPVPERSLNGFLAALARAPASGNCIRDGPALAVVLFNRVCREEAGPQVAALTGCTYSILMDCYCRARRPDLGLALFGRFLREGLKTHQIVANTFLKCLCYAKLTDEAVDVLLHRMSEFGCVPDAISYNTVLKSLCDNGMSQRGLELLQMIAKEVGVCSLNLVAYNTVIYGFFKEGETGKACNLFHEMMQQGVEPDVVTYNLIIDALCKARAMDKAEVVLQQMISKGAQPDTVTYNCMINGYATSGRLKKSAKMFREMKSRGLMPDIVTCNSFLSSLCKHGRSKEAREIFDSMTAKGHKPDIVSYRILLHGYASEGCFADMIDLFNSMKSNGIAADCRVFTILIGAYAKHGMMDDAMLIFTEMQQQGLSPNVVTYSTVISALSRMGRLANAMEKFNQMISMGVQPNKAVYHTLIQGSCMHGDLIKAKELVSEMMNKGIPHPSITFFGSIINSLCKDGRVMDAHDIFDLVIDIGERPSAITFNSLVDGYCLVGKMDKAFGMLNAMESLV

SEQ ID NO: 652 - protein, 593 aa, Triticum aestivum; identical to SEQ ID NO: 651

SEQ ID NO: 653 - protein, 593 aa, Triticum aestivum
MSGLRLRPRRSSSSTFPMPRSRLRHYASAMPMSSLRPLHRSSSSTTSPACAWSPHAAFAAATERVRAGALRPEDAHTLFDELLRQATPVPERSLNGFLAALARAPASGNCIRDGPALAVVLFNRVCREEAGPQVAALTGCTYSILMDCYCRARRPDLGLALFGRFLREGLKTHQIVANTFLKCLCYAKLTDEAVDVLLHRMSELGCVPDAISYNTVLKSLCDNGMSQRGLELLQMIAKEVGVCSLNLVAYNTVIYGFFKEGETGKACNLFHEMMQQGVEPDVVTYNLIIDALCKARAMDKAEVVLQQMISKGAQPHTVTYNCMINGYATSGRLKKSAKMFREMKSRGLMPDIVTCNSFLSSLCKHGRSKEAREIFDSMTAKGHKPDIVSYRILLHGYASEGCFADMIDLFNSMKSNGIAADCRVFTILIGAYAKHGMMDDAMLIFTEMQQQGLSPNVVTYSTVISALSRMGRLANAMEKFNQMISMGVQPNKAVYHTLIQGSCMHGDLIKAKELVSEMMNKGIPRPSITFFGSIINSLCKDGRVMDAHDIFDLVIDIGERPSAITFNSLVDGYCLVGKMDKAFGMLNAMESLV

SEQ ID NO: 654 - protein, 593 aa, Triticum aestivum; identical to SEQ ID NO: 651

SEQ ID NO: 655 - protein, 593 aa, Triticum aestivum; identical to SEQ ID NO: 653

SEQ ID NO: 656 - protein, 593 aa, Triticum aestivum; identical to SEQ ID NO: 651

SEQ ID NO: 657 - protein, 529 aa, Triticum aestivum
MVSIGEHARPPNSAFLLPNPSSCPGCAGAVGGERRRRPLGPLPLPDSSRSIGGAMSRRAVPAGRRILEQNIKARYRAGAIGTDDALHLFDELLQVAWPSSIAAINCLLIVVGRDCPALVVSLFNHIARAKVAPHNITYVILVDCCSRAGRLDLGFAAMGHIVKTGFAAGSVVSFSHLLRAVCAEKKTSYGMDIVLRIMPELNCIPDVYSYSILFKGLCNEKRSQEALELIHVMVEHGGSCQPNLVSYNTVIDGLLKEGEVGKAYSLFCEMVQSGILANIVTYNSIIFGMCKVHAMDKAEKVLQQMFDREILPDTATYTSLIHGYYSSGQCKEVERVFEHMSINGVQPNMITYNIQMDYLCKSGRCAEARKIFDSMVSLGQKPSVTTYSILLHGYVMEKSFHDMHCLLDLMVENGISPDHHVYNILISAYAKEEMASEVMHIFTKMRQQGLNPSVADYGAVINLLSSIGRMDDAMSQFNQMIAEGLAPDIIVFNPLISGFCTCGKWEKVHELFSEMLNRTSTGIRSSRQR

SEQ ID NO: 658 - protein, 490 aa, Triticum aestivum
MVSIGEHARPPNSAFILPNPSSCPGCAGAVGGERRRRPLGPLPLPDSSRSIGGAMSRRAVPAGRRILEQNIKARYRAGAIGTDDALHLFDELLQVAWPSSIAAINCLLIVVGRDCPAPAVSLFNHIARAKVAPHNITYGILVDCCSRAGRLDLGFAAMGHIVKTGFAAGSVVSFSHLLRAVYAKKKTSYGMDIVLRIMPELNCIPDVYSYSILFKGLCNEKRSQEALELIHVMVEHGGSCQPNLVSYNTVIDGLLKEGEVGKAYSLFCEMVQSGILANIVTYNSIIFGMCKVHAMDKAEKVLQQMFDREILPDTATYTSLIHGYYSSGQCKEVERVFEHMSINGVQPNMITYNIQMDYLCKSGRCAEARKIFDSMVSLGQKPSVTTYSILLHGYVMEKSFHDMHCLLDLMVENGISPDHHVYNILISAYAKEEMASEVMHIFTKMRQQGLNPSVAYIRHTQLVCLTGSAMSTHGPPRCSSCGLSITLRCF

SEQ ID NO: 659 - protein, 585 aa, Triticum aestivum
  misc_feature (464)..(464): Xaa can be any naturally occurring amino acid
MVSIGEHARPPNSTFLLPNPSSCPGCAGAVGGERHRRPLGPLPLPDSSRSIGGAMSRRAVPAGRRILEQNIKARYRAGAIGTDDALHLFDELLQVAWPSSIAAINCLLIVVGRDCPTLAVSLFNHIARAKVAPHNITYGILVDCCSRAGRLDLGFAAMGHIVKTGFAAGSVVSFSHLLRAVCAEKKTSYGMDIVLRIMPELNCIPDVYSYSILFKGLCNEKRSQEALELIHVMVEHGGSCQPNLVSYNTVIDGLLKEGEVGKAYSLFCEMVQSGILANIVTYNSIISGMCKVHAMDKAEKVLQQMFDREILPDTATYTSLIHGYYSSGQCKEVERVFEHMSINGVQPNMITYNIQMDYLCKSGRCAEARKIFDSMVSLGQKPFVTTYSILLHGYVMEKSFHDMHCLLDLMVENGISPDHHVYNILISAYAKEEMASEVMHIFTKMRQQGLNPSVADYGAVINLXSSIGRMDDAMPQFNQMIAEGLAPDIIVFNPLIRRSNHHFTLLSQLPLYPTLASPSSCSSFLQENPDLLLPLFFSPKEGKVSASMVLILAKARSCNPETDPITPSLFFFWVCDYGFFSFISI

SEQ ID NO: 660 - protein, 551 aa, Triticum aestivum
MVSIGEHARPPNSAFILPNPSSCPGCAGAVGGERRRRPLGPLPLPDSSRSIGGAMSRRAVPAGRRILEQNIKARYRAGAIGTDDALHLFDELLQVAWPSSIAAINCLLIVVGRDCPAPAVSLFNHIARAKVAPHNITYGILVDCCSRAGRLDLGFAAMGHIVKTGFAAGSVVSFSHLLRAVYAKKKTSYGMDIVLRIMPELNCIPDVYSYSILFKGLCNEKRSQEALELIHVMVEHGGSCQPNLVSYNTVIDGLLKEGEVGKAYSLFCEMVQSGILANIVTYNSIIFGMCKVHAMDKAEKVLQQMFDREILPDTATYTSLIHGYYSSGQCKEVERVFEHMSINGVQPNMITYNIQMDYLCKSGRCAEARKIFDSMVSLGQKPSVTTYSILLHGYVMEKSFHDMHCLLDLMVENGISPDHHVYNILISAYAKEEMASEVMHIFTKMRQQGLNPSVADYGAVINLLSSIGRMDDAMSQFNQMIAEGLAPNIIVFNPLISGFCTCGKWEKVHELFSEMLNRGTYPDTVFFTTIMDRLCKNGRVMEAQDMFGLMI

SEQ ID NO: 661 - protein, 580 aa, Triticum aestivum
MAHPPSKSNPSRAELQIESEIPQSHTSVRRPPSAGRARGWSSPARDRTHHRLRKKRARPLCPVSPPSVLLPPGLQVVAASIHRCCRKTATMSRLQVRSFSSPVSSRANDLLTELHGHLGFGTLRPELAHQLFDEMLRQPVLVSARALSGLFAALARAPPSPACTDGSALAIDLFNCMARAGRRQATVPTIYTYSILIECCHRTCRPDLGLAFFGRLLKTGIPTDIITYSNLFKCLCDMKRTEEALNVLLHRMPDDLPNVISYSVILKSFCDNGRSQLALDLLQMMAKKGANHSPDVMSYNMVIDGFFKEGESSKACDLFHELMQQGVVPDVVMCTSIINALCKARAMDKAEVVLRSMVHNGVQPDVVTYNSLIQGYSTLGQLKELARLLKVMRSQGVMPCVATYNSLMTCLCKNGRFKEAVEIFYSMAVKGQKPDVASYSIILHGYAKEGSLVDMIDLCQLMAANGVIPDLHCFNILIATYAEYGMTDVAMLFFEEMLKQGVHPNEVTYLSVIAGLCKTGRMDDATEKLGEMIDRGVPPDKTVYMCMMEGYFKHGDSLKAKEFITKMKNKDIPHRSQKGN

SEQ ID NO: 662 - protein, 304 aa, Triticum aestivum
MQRRKGYECTSIFDLVIGMGERPNVITFSSLIDGYGLVGQMGKALGVLDAMVSAGIEPNVVTYSSLLDGYCKNGRINDALILFREMPHKRIKPNTVTYGVMLDGLFRAGRTVAAREMFHEMTERGIPVSISIYNIILGGLCRNNCADEAIALFQKLGARNVKFDIITLNTMINAMFKVRRREEANDLFAAISASGLVPDASTYGIMIENILKEGSVEEVDNMFSSMEKSGCAPSSRLINYVIRMLLEKGEIARAGNYLSKVDGKIISLEASTTSLLLSLFSREGKYRENIELLPAKYQFFNGFG

SEQ ID NO: 663 - protein, 304 aa, Triticum aestivum; identical to SEQ ID NO: 662

SEQ ID NO: 664 - protein, 569 aa, Triticum aestivum
MMHQGVEPSVWTYSSIIDALCKARAMDKAELVLQQMVNKGVQPNNVTYNCMIHGYSTSGRWKEAAKLFREMKSRGLIPDTFTCNALMTYLCKHGRSKEAAEFFDAMTAKGHRNVNSYCILLHGYANEGCFADMIDLFNSMESNGFVADCHVFTILIDAYAKRGMMDEAMLIFTEMREKGVSPNVVTYSTVIAALCRLGRLSDAMDRFNEMTDMGVQPNTAVYRSLIQGFCMLGDLVKVKEFVSEMMNKGIPRPDIAFFTSVINSLCKEGRVMNAQGIFDLVIGMGERPNVIIFSSLIDGYGLVGQMGKALGVLDAMVSAGIEPNVVTYSSLLDGYCRNGRINDALILFREMPHKRIKPDTVTYGIMLDGLFRAGRTVAAREMFHEMTERGIPVSISIYNIILRGLCRNNCADEAIALFQKLGARNVKFDIITLNTMINAMFKVRRREEANDLFSAISASGLVPNASTYGIMIENILKEGSVEEVDNMFSSMEKSGCAPSSRLINYVIRMLLEKGEIARAGNYLSKVDGKIISLEASTTSLLLSLFSREGKYRENIELLPAKYQFFNGFG

SEQ ID NO: 665 - protein, 569 aa, Triticum aestivum; identical to SEQ ID NO: 664

SEQ ID NO: 666 - protein, 304 aa, Triticum aestivum; identical to SEQ ID NO: 662

SEQ ID NO: 667 - protein, 304 aa, Triticum aestivum; identical to SEQ ID NO: 662

SEQ ID NO: 668 - protein, 569 aa, Triticum aestivum; identical to SEQ ID NO: 664

SEQ ID NO: 669 - protein, 446 aa, Triticum aestivum
MLRQPVPVSARALGGLFSALARAPPSTACTDGPALAIDLFNCMTRVSRRRVIAPDIYTYNILIDCCHKACRPDLGPAFFGCLLKTGITMSVITYSSLFKCLCDMKRTDEALDVLLHRMPEDLPDIISYSVILKSFCDNGRSQCALDLLRMMAKKGTDHSPNVVSYNLVIDGFFKEGEGSKACDLFHEMIQQGPVPDVVTYTSVIVALCKARAMDKAEVVLRQMVHDGVQPNTVTYNSLIQGYSTLGQLKEVARLLKVMRSQGVLPSAVTCSSVMDYLCKHGRIKEAEEIFYSMAVNGRKPDIVSYSIMLLGYAMEGSLVKMIDLCELMARDGVVPDLRCFNILINAYAKYGRMDVAMLFFEDMLKQGVKPNEFTYLTVISVFCKMGRMDDAMEKFSEMIDMGVPPDTKVYMCMVEGYLNLGDSMKAKEFITKMKNMDIHHRPRKGN

SEQ ID NO: 670 - protein, 417 aa, Triticum aestivum
MRCCCRARRPGLGLAFFGRLLRTGLRTDGVDAYALIKCFCLAKRTDEAVSVRLHRLPELGRVPDALSYSVVLKVLCDDGRSQRALGLLQMMWKEGGGCAPNVVAYSTVIHGFCKEGKVSKACELFNEMVQQGVKPNVVTYTQVIDALCKARAMDKAESFLRHMVDNDVRPNNVTYKCIIQGYSSLGWWEEAVKIFRETTSRGLILDDVTRNSFVSSLCNHGRSKEAAEIAHQIIENGTTVSISTYGIILGELCRNDCTEEAIVLFHKLGAVDVKFDITIFNTMIDAMYRVRRREEANILFAAISANGLVPNASTYRIMITNLLKEGSMEEADHMFSSMETSGYAPSSVLLNDIIRMLLEKGEIVKAGNYLSKVDGKSISLEASTGLLMRHLFSTEGKYHEQIKSLPERYQYFGVRHS

SEQ ID NO: 671 - protein, 417 aa, Triticum aestivum; identical to SEQ ID NO: 670

SEQ ID NO: 672 - protein, 417 aa, Triticum aestivum; identical to SEQ ID NO: 670

SEQ ID NO: 673 - protein, 417 aa, Triticum aestivum; identical to SEQ ID NO: 670

SEQ ID NO: 674 - protein, 417 aa, Triticum aestivum; identical to SEQ ID NO: 670

SEQ ID NO: 675 - protein, 417 aa, Triticum aestivum; identical to SEQ ID NO: 670

SEQ ID NO: 676 - protein, 391 aa, Triticum aestivum
MPGFSSAASMSPLRLRLRLHARHSSASQPSRRQGWDPHAAFAAATECARSGNLTPEDAHNLFDELLRQGNPVLGRPLNNLLAALARAPASSACRDGPALVVALFSRISQGARLRVLHPTACTYGILMDCSCRAHRLDLAFAFFGRLLRTGLKAGVIEVNSLLKGLCHAKRADEAMEVLLHRMPELFIGVQGTAVYRSLIQGFCTHGDLVKAKEYVTEMMKKGMPPPDIMFFSSIMQNLCTEGRVIEARDILDLIVRIGMRPDVFIFNILIGGYCLVGKMEDASKIFDDMVSYGLEPCNFTYGILINGYCKNKRIDDGLILFKEMLRKGLKPTTFNYNVILDGLFLAGQTVAAKEKFDEMVESGVSVCIDTYSIVLGGLCRNSCSSEAITLF

SEQ ID NO: 677 - protein, 391 aa, Triticum aestivum; identical to SEQ ID NO: 676

SEQ ID NO: 678 - protein, 484 aa, Triticum aestivum
MSRLQVRSFSNSVSSHANELLDKLQGHLHSRTLRPDLVHQLFDEMLRQPVPVSVRALNGLFAALARAPSSTICTDAPALAIDLFNRMARAGRRQVPAPTIHTYSMLIECCQRACRPDLGLAFFGRLLKTGIKTNAITYSSLLKCLCDMKRTEEALGVLLHRMPDDLPNAISYSVILKSFCDSGRSQLVLDLLRMMAEKGSDHSPSVVSYSLVIDGFFKEGEISKACNLLHEMMQQGVVPDVVTYNSFIDALCKARAMEKAEVVLRSMVHNGVQPNAVTYSSLIQGYSTLGQLKEVARLLKAMRSQGSMPDVVICSSVMDYLCKHGRIKDAEEIFYSMAVNGRKPDIVSYTIMLHGYAIEGSLVKMIDLCELMARDGVVPDLRCAYAKYGMMDVAMLFLEDMLKQGVKPNEFTYLTVISAFCKMGRMDDAMEKFSEMIDMGVPVDTEVYMCMVEGYFNHGDSMKAEKFITKMKNRDIHHKLRKGN

SEQ ID NO: 679 - protein, 490 aa, Triticum aestivum
MSRLQVRSFSNSVSSHANELLDKLQGHLHSRTLRPDLVHQLFDEMLRQPVPVSVRALNGLFAALARAPSSTICTDAPALAIDLFNRMARAGRRQVPAPTIHTYSMLIECCQRACRPDLGLAFFGRLLKTGIKTNAITYSSLLKCLCDMKRTEEALGVLLHRMPDDLPNAISYSVILKSFCDSGRSQLVLDLLRMMAEKGSDHSPSVVSYSLVIDGFFKEGEISKACNLLHEMMQQGVVPDVVTYNSFIDALCKARAMEKAEVVLRSMVHNGVQPNAVTYSSLIQGYSTLGQLKEVARLLKAMRSQGSMPDVVICSSVMDYLCKHGRIKDAEEIFYSMAVNGRKPDIVSYTIMLHGYAIEGSLVKMIDLCELMARDGVVPDLRCFNILINAYAKYGMMDVAMLFLEDMLKQGVKPNEFTYLTVISAFCKMGRMDDAMEKFSEMIDMGVPVDTEVYMCMVEGYFNHGDSMKAEKFITKMKNRDIHHKLRKGN

SEQ ID NO: 680 - protein, 490 aa, Triticum aestivum
MSRLQVRSFSNSVSSHANELLDKLQGHLHSRTLRPDLVHQLFDEMLRQPVPVSVRALNGLFAALARAPSSTICTDAPALAIDLFNRMARAGRRQVPAPTIHTYSILIECCQRACRPDLGLAFFGRLLKTGIKTNAITYSSLLKCLCDMKRTEEALGVLLHRMPDDLPNAISYSVILKSFCDSGRSQLVLDLLRMMAEKGSDHSPSVVSYSLVIDGFFKEGEISKACNLLHEMMQQGVVPDVVTYNSFIDALCKARAMEKAEVVLRSMVHNGVQPNAVTYSSLIQGYSTLGQLKEVARLLKAMRSQGSMPDVVICSSVMDYLCKHGRIKDAEEIFYSMAVNGRKPDIVSYTIMLHGYAIEGSLVKMIDLCELMARDGVVPDLRCFNILINAYAKYGMMDVAMLFLEDMLKQGVKPNEFTYLTVISAFCKMGRMDDAMEKFSEMIDMGVPVDTEVYMCMVEGYFNHGDSMKAEKFITKMKNRDIHHKLRKGN

SEQ ID NO: 681 - protein, 490 aa, Triticum aestivum; identical to SEQ ID NO: 679

SEQ ID NO: 682 - protein, 490 aa, Triticum aestivum; identical to SEQ ID NO: 679

SEQ ID NO: 683 - protein, 490 aa, Triticum aestivum; identical to SEQ ID NO: 679

SEQ ID NO: 684 - protein, 542 aa, Triticum aestivum
MPRLSSTTPMSPPRLRLRLRGRHSSSTSHPSRIWDPHAAFAGATQRAHSGNLTPEDAHHLFDELLRQGNPVQERPLTNFLAALARAPASASCSDGPALAVALFGRLSRGAGRRVAQPNVFTYGVLMDCCCRACRPDLALAFFGRLFRKGLEANRVIFCTLLKGLCHAKRTDEALDVLLHRMPELGCTPNVVAYTTVIHGFFKEGQVGKACNLFHGMAQQGVAPNLVTYNSVIDALCKAKAMDKAEYFLGQMVDDGVVPDNVTYNSLIHGYSSSGHWKEAVRVFKEMTSRRVTADVHTYNMFMTFLCKHGRSKEAAGIFDTMAIKGLKPDNVSYAILLHGYATEGCLVDMINLFNSMERDCILPDCRIFNILINAYAKSGKLDKAMLIFNEMQKQGVSPNAVTYSTVIHTFCKKGRLDDAVIKFNQMIDTGVRQGTAVYGSLIQGFCTHGDLVKAKELLTEMMNKGMLPPDIKFFHSIMQNLCTEGRVIEARDVLGLIAHIGMRPDVCTFNILIGGYCLVGKMEDASKIFDDMMSYGLEPSNC

SEQ ID NO: 685 - protein, 542 aa, Triticum aestivum; identical to SEQ ID NO: 684

SEQ ID NO: 686 - protein, 537 aa, Triticum aestivum
MVEHGGSCQPNVVTYSTVIDGLLTEGEVNKAYSLFCEMLQRGISPNVVTCSSIISGMCKLHAMDKAEEVLQQMFERRILPDVATYTSLIHGYYSLGQCKEVDWILWEMSRNGVQPDIVTYNIQMDYLCKSGRCAKARKIFDSMVGLGQKPDVTTYNVLLHGYAMERSFHDMNCLIELMDDNGISPDHYGYNILISAYAKEKMVDEVMHIFTKMRQQGLNPDVVNYGAAVNLLSKIGRMDDAMSQFNQMITEGLAPDIIVFTPLISGFCSCGKWEKVDELFSEMLDRGICPNTVFFNTIMDRLCKNERVMEAQDLFDLMVHMGVKPDVCTYNTLIGGYLFVGKMDEVSKLLDNMVSIGMEPDVITYNILIDGYSKNGKIDDALVVFRGMLERKDKPSVITFNIMIGALLKCHRKEEAKDLFDGIWAKGLVPDVVTYSLMIQKLIEEGSLQESDDLFLSMEKNGCAADSRMLNAIVRSLLQKGDVPRAGTYLSKINERSFTLEGSTATLLTALASGGRGQEYKELLPEKYHSFLEQGID

SEQ ID NO: 687 - protein, 537 aa, Triticum aestivum; identical to SEQ ID NO: 686

SEQ ID NO: 688 - protein, 537 aa, Triticum aestivum; identical to SEQ ID NO: 686

SEQ ID NO: 689 - protein, 537 aa, Triticum aestivum; identical to SEQ ID NO: 686

SEQ ID NO: 690 - protein, 537 aa, Triticum aestivum; identical to SEQ ID NO: 686

SEQ ID NO: 691 - protein, 537 aa, Triticum aestivum; identical to SEQ ID NO: 686

SEQ ID NO: 692 - protein, 221 aa, Triticum aestivum
MIAVSLFNRLCREASPHASPLTVHTYGILTDCCCRARRPDLGLAFFGRLLRTGLRTDGVDAYALIKCFCLAKRTDEAVSVLLHRLPELGCAPDALSYSVVLKVLCDDGRSQRAFDLLQMMSKEGGGCAPNVVAYSTVIHGFCKEGKVSKACDLFDEMVQQGVKPNVVTYTSIIDALCKARAMDKAESFLRHMVDNDVRPAILSTLLDYIGLYFPPLYYFWD

SEQ ID NO: 693 - protein, 543 aa, Triticum aestivum
MAVMPRLHSTTPMPRLLRRLSSTSTSTSAPSRCWDPSAALAAATERVRAGTLRPADAHQLFDELLQQATPVPGPALNGFLAALARAPASAACTDSPALAVSLFNRLCREASPHASPLTVHTYGILTDCCCRARRPDLGLAFFGRLLRTGLRTDGVDAYALIKCFCLAKRTDEAVSVLLHRLPELGCAPDALSYSVVLKVLCDDGRSQRAFDLLQMMSKEGGGCAPNVVAYSTVIHGFCKEGKVSKACDLFDEMVQQGVKPNVVTYTSIIDALCKARAMDKAESFLRHMVDNDVRPNNVTYKYMIQGYSSLGWWEEAVKIFRETTSRGLILDDVTRNSFVASLCNHGRSKEAAEIARQMIETGTTVSISTYGIILGELCRNNCTEEAIVLFHKLGAVNVKFDITIFNTMIDAMYRVRRREEANILFAAISANGLVPNASTYRIMITNLLKEGSMEEADHMFSSMETSGYAPSSVLLNDIIRMLLEKGEIVKAGNYLSKVDGKSISLEDSTGLSMVHLFSREGKYHEQIKSLPAIYRFFGGVRHS

SEQ ID NO: 694 - protein, 544 aa, Triticum aestivum
MAVMPRFHSTTPTPRLLRRLSSTSASTSAPPRCWDPSAALTAATERVRAGTLSPADAHHLFDELLQRPTPVPGPALNGFLAALARAPASAACRDSPSLAVSIFNRLCREASPHGHASPLTAHTYGILMRCCCRARRPGLGLAFFGRLLRTGLRTDGVDAYALIKCFCLAKRTDEAVSVLLHRLPELGRVPDALSYSVVLKVLCDDGRSQRALGLLQMMWKEGGGCAPNVVAYSTVIHGFCKEGKVSKACELFNEMVQQGVKPNVVTYTSVIDALCKARAMDKAESFLRHMVDNDVRPNNVTYKCIIQGYSSLGWWEEAVKIFRETTSQGLILDDVTRNSFVSSLCNHGRSKEAAEIAHQIIENGTTVSISTYGIILGELCRNDCTEEAIVLFHKLGAVDVKFDITIFNTMIDAMYRVRRREEANILFAAISANGLVPNASTYRIMITNLLKEGSMEEADHMFSSMETSGYAPSSVLLNDIIRMLLEKGEIVKAGNYLSKVDGKSISLEASTGLLMRHLFSTEGKYHEQIKSLPERYQFFGVRHG

SEQ ID NO: 695 - protein, 293 aa, Triticum aestivum
MFDFILGIGRRPDVIMYNSLMDGYCLVGKVEEALRVLDAMKSAGLQPTAVTYAILLNGYCKIGRIADGLSLFREMSLSGVKPTTFMYNIIFDGLFRSGRAVSAKEKFRTMTESGIPVGVDTYYIVLHGLCKNNCTGEAIELFKKLRAMNVKIDVITLNTMISVMFKTRRIEEAKDLFATISAIGLVPSVVTYSVMMTNFIEEGLLAEADDMFLAMEKAGCAPDSRLLNHVVRVLLENGAVVKAATYLAKLDAKQLSVEASTVSLILSLFSRKGKLREHVKLLPVKYQPPEMLD

SEQ ID NO: 696 - protein, 534 aa, Triticum aestivum
MVDQGIEPNIKTYNCLIHGYSTFGQWKEALRVFKEMASLGVVPDVVTLTSLIDSLCKHRRTKEAREIFDSMAAKGLKPNIVSYSTMLNGYVKEGSFEDMTDLFNSMVRNGVVPNHHIFNILINAYAKRGLMDEAMHMFEVMRQQGVNPDVVDYLVIMDSLCKMGRMDAALDKFNQMVNQGVSPNKAVYQCLVLGSCSHGHFVKAKDLISEAINRGLFSNSVFFYPVINDLCKEGKVNEAQDMFDFILGIGRRPDVIMYNSLMDGYCLVGKVEEALRVLDAMKSAGLQPTAVTYAILLNGYCKIGRITDGLSLFREMSLSGVKPTTFMYNIIFDGLFCSGRAVSAKEKFRTMTESGIPVGVDTYNIVLHGLCKNNCTGEAIELFKKLRAMNVKIDVITLNTMISVMFKTRRIEEAKDLFATISAIGLVPSIVTYSVMMTNFIEEGLLAEADDMFLAMEKAGCAPDSRLLNHVVRVLLENGAVVKAATYLAKLDAKQLSVEASTVSLILSLFSRKGKLREHVKLLPVKYQPPEMLD

SEQ ID NO: 697 - protein, 534 aa, Triticum aestivum; identical to SEQ ID NO: 696

SEQ ID NO: 698 - protein, 293 aa, Triticum aestivum; identical to SEQ ID NO: 695

SEQ ID NO: 699 - protein, 208 aa, Triticum aestivum
MYNIIFDGLFRSGRAVSAKEKFRTMTESGIPVGVDTYNIVLHGLCKNNCTGEAIELFKKLRAMNVKIDVITLNTMISVMFKTRRIEEAKDLFATISAIRLVPSVVTYSVMMTNFIEEGLLAEADDMFLAMEKAGCAPDSRLLNHVVRVLLENGAVVKAATYLAKLDAKQLSVEASTVSLILSLFSRKGKLREHVKLLPVKYQPPEMLD

SEQ ID NO: 700 - protein, 384 aa, Triticum aestivum
MSRRFVPVDRRILERNIKARYHAGDIGTEDALNLFDELIQVAGPSSVLAINCLLTVVGRDCPALGVSLFNRVARAKVPPHNITYSILVDCCCRAGRLDLGHAAMGHVIKLGFAAEAIVNFSHLLKAICAEKKTSYAMDIVLRIMPEFNCIPNIFSYNILFKGLCNEKRSQEAPELIHIMAEDGGSCQPNVVSYNTVIDGLLKEGEVGQAYSLFCVMLQRGISPNVVTCTSIISGMCKVHAMDKAEEVLQQMTDRRILPDVATYNSLIHGYYSLGQCKEVDRIFKEMTRNGVQPNVVTYNIQMDYLCKSGRCAEARKIFDSMISLGQKPTVTTYNILLHGYAMERSFHDMNCIIELMDDNGISPDHYCYNILISAYKKKRATWCM

SEQ ID NO: 701 - protein, 545 aa, Triticum aestivum
MSRRFVPVDRRILERNIKARYHAGDIGTEDALNLFDELIQVAGPSSVLAINCLLTVVGRDCPALGVSLFNRVARAKVPPHNITYSILVDCCCRAGRLDLGHAAMGHVIKLGFAAEAIVNFSHLLKAICAEKKTNYAMDIVLRIMPEFNCIPNIFSYNILFKGLCNEKRSQEALELIHIMAEDGGSCQPNVVSYNTVIDGLLKEGEVGQAYSLFCVMLQRGISPNVVTCTSIISGMCKVHAMDKAEEVLQQMTDRRILPDVATYNSLIHGYYSLGQCKEVDRIFKEMTRNGVQPNVVTYNIQMDYLCKSGRCAEARKIFDSMISLGQKPTVTTYNILLHGYAMERSFHDMNCIIELMDDNGISPDHYCYNILTSAYAKEKMVDEVMHISTKMRQQGLNPDVENYGAVVNLLSKIGRMDDAMSQFNQMITEGLAPDIIVFTPLISGFCSCGKWEKVDELFSEMLDRGICPDTVFFNTVMDHLCKNGRVIEAQDVFDLMVHMGVKPDVRSHVTLMHGYFADGKMDEMRKLLENMCSIGLKLMLSPIAY

SEQ ID NO: 702 - protein, 543 aa, Triticum aestivum
MPRFSSSTPMSPPRLRLRLGGRHSSSTSHPSRIWDPHAAFATGTERAVFGTLTTEDAHHLFDELLRHGNPVQERSLNNFLATLARAPTSASCSDGPALAVALFGRLSRGAGRRVAQPNVFTYGVLMDCCCRARRLDLVIAFFGRLLKTGLEADRVVFSTLLKGLCHAKRSDEALDVLLHRMPGLGCTPGVVAYNTVIHGFFKEGQVGKACNLFHEMAQQGVMPDVVTYSSVIDALCKARAMDKAEYFLRQMVDDGVVPNNVTYNSLIHGYSSSGHWKEAVRVFKEMTSRRVTPDVHTYNMFMTFLCKHGRSKEAAGIFETMAMKGLKPNNVSYAILLHGYATEGCLVDMINLFNSMTRDGIRPNCHTLNILINAYAKSGMMDEAMLIFKGMRKQGVSPDVVTYSTVIHAFCKMGSLDIAMDKFNQMVDMGVRPNAVVYHSLIQSFCTHGDFVKAKELVTEMRNKGMRPPDINFFHSIMQNLCTEGRVTEARDILDLIVHIGMRPDVLIFSLLIDGYCLVSKMEDASKIFDDMVSYGLEPSNIT

SEQ ID NO: 703 - protein, 543 aa, Triticum aestivum; identical to SEQ ID NO: 702

SEQ ID NO: 704 - protein, 543 aa, Triticum aestivum; identical to SEQ ID NO: 702

SEQ ID NO: 705 - protein, 543 aa, Triticum aestivum; identical to SEQ ID NO: 702

SEQ ID NO: 706 - protein, 543 aa, Triticum aestivum; identical to SEQ ID NO: 702

SEQ ID NO: 707 - protein, 418 aa, Triticum aestivum
MDCCCRARRLDLVIAFFGRLLKTGLEADRVVFSTLLKGLCHAKRSDEALDVLLHRMPGLGCTPGVVAYNTVIHGFFKEGQVGKACNLFHEMAQQGVMPDVVTYSSVIDALCKARAMDKAEYFLRQMVDDGVVPNNVTYNSLIHGYSSSGHWKEAVRVFKEMTSRRVTPDVHTYNMFMTFLCKHGRSKEAAGIFETMAMKGLKPNNVSYAILLHGYATEGCLVDMINLFNSMTRDGIRPNCHTLNILINAYAKSGMMDEAMLIFKGMRKQGVSPDVVTYSTVIHAFCKMGSLDIAMDKFNQMVDMGVRPNAVVYHSLIQSFCTHGDFVKAKELVTEMRNKGMRPPDINFFHSIMQNLCTEGRVTEARDILDLIVHIGMRPDVLIFSLLIDGYCLVSKMEDASKIFDDMVSYGLEPSNIT

SEQ ID NO: 708 - protein, 517 aa, Triticum aestivum
MRPCRTPLLDSTSPLSVLLLDHLHRNRPSPPPSASPPSAFWSPIAAFAAATKRARAGTLSPEDAHHLFDELLRQSNPVPNRFLNNFLAALARAPPSDVCGDGPALTVALFNRLCREEAGPCVAPPTIYTYSILMDSCCRVGRPDLGLAVFGRLLKSGFKADQITASSLLMCLCDVGQTNEPVDVLLRRISKLGCEPNVIPYNIVLKSLCDSRRSQQALDLLLMMAQRGCRSPDVVSYNIVIHGLFKEGEVSMACSLFYEMMRQRVMPNVVTYRSMIGALCKVGATDKAKMVLGHMVGNGFRPDMYTWNSFMASLCKQGRSKEAAQLFDYMVAKGYKPDVVTYSTLLHGYATEGCFTDMINLFNSMEGNGIVANSCVFNILIDAYAKRGMMHEAMLIFTEMRERRVSPDIFTYGIIIAALCRMGRLSDAMEKINEMVAAGLQPDKAVYYSLIQGFCTHDDLVKAKELVSEMMTKGIPRPNIVFFNSVIASLCKEGRVKDAHGIFDLAMNIGERPDLIH

SEQ ID NO: 709 - protein, 268 aa, Triticum aestivum
MSLLRLRLRLHARRSYSTSHPPRSQGWDPHAAFAAATERARSGNLTSEDAHKLFDQLLLQANPVNMRLPNDLLTALARAPAFAACSNGPALAVALFSRLSQSARQRVVQPTACTHGILMDCCCRAHRLDLALAFFARLLRTGLKAGVIEVNTLLKGLCRAKRADEALDILLHRMPELGCTPNVVAYTTVIHGFFKEGQVSKACNLFHEMALQGVTPDVVTYNSVIDALCKARAMDKAEYFLGQMVDDGVVPDNVTYNSLIHGYSFSGH

SEQ ID NO: 710 - protein, 519 aa, Triticum aestivum
MSLLRLRLRLHARRSYSTSHPPRSQGWDPHAAFAAATERARSGNLTSEDAHKLFDQLLLQANPVNMRLPNDLLTALARAPAFAACSNGPALAVALFSRLSQGARQRVVQPTACTHGILMDCCCNAHRLDLALAFFARLLRTGLKAGVIEVNTLLKGLCRAKRAHEALDILLHRMPELGCTPNVVAYTTVIHGFFKEGQVSKACNLFHEMALQGVTPDVVTYNSVIDALCKARAMDKAEYFLGQMVDDGVVPDNVTYNSLIHGYSFSGHWKEAVRVFKQMTSRRVTADVHTYNMFMTFLCKHGRSKEAAGIFDTMAIKGLKPDNVSYAILLHGYATEGCLVDMINLFNSMERDCILPDCRIFNILINAYAKSGKLDKAMLIFNEMQKQGVSPNAVTYSTVIDAFCKKGQLDDAMIKFNQMIDTGIRQGTTVYGFCTHGDLVKAKELLTEMMNKGIPPPDIKFFHSIMQNLGTEGRVIEARDVLGLIAHIGMRPNVCTFNILSGGYCLSARWRMPQKYLMI

SEQ ID NO: 711 - protein, 246 aa, Triticum aestivum
MTSRRVTADVHTYNMFMNFLCKHGRSKEAAGIFDTMAIKGLKPDNVSYAILLHGYATEGCLVDMINLFNSMERDCILPDCRIFNILINAYAKFGKLDKAMLIFNEMQKQGVSPNAVTYSTVIDAFCKKGQLDDAMIKFNQMIDTGIRQGTTVYGSLIQGFCTHGDLVKAKELVTEMMNKGIPPPDIKFFHSIMQNLGTEGRVIEARDVLGLIAHIGMRPNVCTFNILSGGYCLSARWRMPQKYLMI

SEQ ID NO: 712 - protein, 553 aa, Triticum aestivum
MVSIGEHARPPNSAFLLPNPSSCPGCVGAVGGERHRRPLGPLPLPDSSRSIGGAMSRRAVPAGRRILEQNIKARYRAGAIGTDDALHLFDELLQVAWPSSIATINCLLIVVGRDCPALAVSLFNHIARAKVAPHNITYGILVDCCSRAGRLDLGFAAMGHIVKTGFAAGSVISFSHLLRAVCAEKKTSYGMDIVLRIMPELNCIPDVYSYSILFKGLCNEKRSQEALELIHVMVEHGGSCQPNLVSYNTVIDGLLKEGEVGKAYSLFCEMVQSGILANIVTYNSIISGMCKEVERVFEHMSINGVQPNMITYNIQMDYLRKSGRCAEARKIFDSMVSLGQKPYVTTYSILLNGYVMEKSFHDMHCLLDLMVENGILPDHHVYNILISAYAKEEMASEVMHIFTKMRQQGLNPSVADYGAVINLHSSIGRMDDAMPQFNQMIAEGLAPDIIVFNPLISGFCTCGKWEKVHELFSEMLNRGTYPDTVFFTTIMDRLCKNGRVMEAQDMFDLMVHVGVKPNVHTYATLMHGYFFVRKMDEVRKLLGNMLSIGSKPD

SEQ ID NO: 713 - protein, 553 aa, Triticum aestivum
MVSIGEHARPPNSAFLLPNPSSCPGCAGAVGGERRRRPLGPLPLPDSSRSIGGAMSRRAVPAGRRILEQNIKARYRAGAIGTDDALHLFDELLQVAWPSSIAAINCLLIVVGRDCPALAVSLFNHIARAKVAPHNITYGILVDCCSRAGRLDLGFAAMGHIVKTGFAAGSVVSFSHLLRAVCAKKKTSYGMDIVLRIMPELNCIPDVYSYSILFKGLCNEKRSQEALELIHVMVEHGGSCQPNLVSYNTVIDGLLKEGEVGKAYSLFCEMVQSGILANIVTYNSIISGMCKEVERVFEHMSINGVQPNMITYNIQMDYLCKSGRCAEARKIFDSMVSLGQKPSVTTYSILLHGYVMEKSFHDMHCLLDLMVENGISPDHHVYNILISAYAKEEMASEVMHIFTKMRQQGSNPSVADYGAVINLLSSIGRMDDAMSQFNQMIAEGLAPDIIVFNPLISGFCTCGKWEKVHELFSEMLNRGTYPDTVFFTTIMDRLCKNGRVMEAQDMFDLMVHVGVKPNVHTYATLMHGYFFVRKMDEVRKLLGNVLSIGSKPD

SEQ ID NO: 714 - protein, 553 aa, Triticum aestivum
MVSIGEHARPPNSTFLLPNPSSCPGCAGAVGGERHRRPLGPLPLPDSSRSIGGAMSRRAVPAGRRILEQNIKARYRAGAIGTDDALHLFDELLQVAWPSSIAAINCLLIVVGRDCPALAVSLFNHIARAKVAPHNITYGILVDCCSRAGRLDLGFAAMGHIVKTGFAAGSVVSFSHLLRAVCAKKKTSYGMDIVLRIMPELNCIPDVYSYSILFKGLCNEKRSQEALELIHVMVEHGGSCQPNLVSYNTVIDGLLKEGEVGKAYSLFCEMVQSGILANIVTYNSIISGMCKEVERVFEHMSINGVQPNMITYNIQMDYLCKSGRCAEARKIFDSMVSLGQKPSVTTYSILLHGYVMEKSFHDMHCLLDLMVENGISPDHHVYNILISAYAKEEMASEVMHIFTKMRQQGSNPSVADYGAVINLLSSIGRMDDAMSQFNQMIAEGLAPDIIVFNPLISGFCTCGKWEKVHELFSEMLNRGTYPDTVFFTTIMDRLCKNGRVMEAQDMFDLMVHVGVKPNVHTYATLMHGYFFVRKMDEVRKLLGNVLSIGSKPD

SEQ ID NO: 715 - protein, 553 aa, Triticum aestivum
MVSIGEHARPPNSAFLLPNPSSCPGCVGAVGGERHRRPLGPLPLPDSSRSIGGAMSRRAVPAGRRILEQNIKARYRAGAIGTDDALHLFDELLQVAWPSSIAAINCLLIVVGRDCPALAVSLFNHIARAKVAPHNITYGILVDCCSRAGRLDLGFAAMGHIVKTGFAAGSVVSFSHLLRAVCAKKKTSYGMDIVLRIMPELNCIPDVYSYSILFKGLCNEKRSQEALELIHVMVEHGGSCQPNLVSYNTVIDGLLKEGEVGKAYSLFCEMVQSGILANIVTYNSIISGMCKEVERVFEHMSINGVQPNMITYNIQMDYLCKSGRCAEARKIFDSMVSLGQKPSVTTYSILLHGYVMEKSFHDMHCLLDLMVENGISPDHHVYNILISAYAKEEMASEVMHIFTKMRQQGSNPSVADYGAVINLLSSIGRMDDAMSQFNQMIAEGLAPDIIVFNPLISGFCTCGKWEKVHELFSEMLNRGTYPDTVFFTTIMDRLCKNGRVMEAQDMFDLMVHVGVKPNVHTYATLMHGYFFVRKMDEVRKLLGNVLSIGSKPD

SEQ ID NO: 716 - protein, 553 aa, Triticum aestivum; identical to SEQ ID NO: 715

SEQ ID NO: 717 - protein, 510 aa, Triticum aestivum
MMSELGCVPNAFSYSIVLKGLCDNSMCQRALELLQMLVEKEGACSLNVVAYSTVIHGFFKEGETSKACNLFDEMIQQGIVPDVVTYSSIIDALCKARAMDKSELVLRQMVANGAQPNEVTYNCMIHGYSTSGRWKEAVKLFREMKSRGLIPDIFTCNSLMTYHCKHGRSKEAAEFFYSMTAKGHKPDIVSYRILLHGYATEGCFPDMIDVFNSMENNGIAADCHVFNILIDAYSKRGMMDETMLITSKMQERRVNPDIVTYSSIIAGLSRLGRLTEAMEKFNQMIALGVQPNKVVYHALIQGFCIDGDLAKAKQLVSEMMNRGIPRPNISFFSSVIKSLCQEGRVMDAHDIFDLVIDMGERPDDILLNSLIDGYCLVGKMDKALKVLDVMESVGVEPDVITYNTLVNGYCRNGRINDGLTLFRDMARKRIKPDTVFILRHNGWVVSFWEICFCYGAARRRAREGRPGAFLPTAGQEGRDFLLNSCLIRLIHLLSLYREVYLTPKQGLLDP

SEQ ID NO: 718 - protein, 510 aa, Triticum aestivum; identical to SEQ ID NO: 717

SEQ ID NO: 719 - protein, 510 aa, Triticum aestivum
MMSELGCVPNAFSYSIVLKGLCDNSMCQRALELLQMLVEKEGACSLNVVAYSTVIHGFFKEGETSKACNLFDEMIQQGIVPDVVTYSSIIDALCKARAMDKSELVLRQMVANGAQPNEVTYNCMIHGYSTSGRWKEAVKLFREMKSRGLIPDIFTCNSLMTYHCKHGRSKEAAEFFYSMTAKGHKPDIVSYRILLHGYATEGCFPDMIDVFNSMENNGIAADCHVFNILIDAYSKRGMMDETMLITSKMQERRVNPDIVTYSSIIAGLSRLGRLTEAMEKFNQMIALGVQPNKVVYHALIQGFCIDGDLAKAKQLVSEMMNRGIPRPNISFFSSVIKSLCQEGRVMDAHDIFDLVIDMGERPDDILLNSLIDGYCLVGKMDKALKVLDVMESVGVEPDVITYNTLVNGYCRNGRINDGLTLFSDMPRKRIKPDTVFILRHNGWVVSLWEICFCYGAARRRAREGRPGAFLPTAGQEGRDFLLNSCLIRLIHLLSLYREVYLTPKQGLLDP

SEQ ID NO: 720 - protein, 510 aa, Triticum aestivum
MMSELGCVPNAFSYSIVLKGLCDNSMCQRALELLQMLVEKEGACSLNVVAYSTVIHGFFKEGETSKACNLFDEMIQQGIVPDVVTYSSIIDALCKARAMDKSELVLRQMVANGAQPNEVTYNCMIHGYSTSGRWKEAVKLFREMKSRGLIPDIFTCNSLMTYHCKHGRSKEAAEFFYSMTAKGHKPDIVSYRILLHGYATEGCFPDMIDVFNSMENNGIAADCHVFNILIDAYSKRGMMDETMLITSKMQERRVNPDIVTYSSIIAGLSRLGRLTEAMEKFNQMIALGVQPNKVVYHALIQGFCIDGDLAKAKQLVSEMMNRGIPRPNISFFSSVIKSLCQEGRVMDAHDIFDLVIDMGERPDDILLNSLIDGYCLVGKMDKALKVLDVMESVGVEPDVITYNTLVNGYCRNGRINDGLTLFSDMPRKRIKPDIVFILRHNGWVVSFWEICFCYGAARRRAREGRPGAFLPTAGQEGRDFLLNSCLIRLIHLLSLYREVYLTPKQGLLDP

SEQ ID NO: 721 - protein, 510 aa, Triticum aestivum; identical to SEQ ID NO: 717

SEQ ID NO: 722 - protein, 469 aa, Triticum aestivum
MSNLRLLRRSSSSMSTTRSPLSRVWSPHSAFAAATERVRTGTLSQDDAHHLFDELLRQATPVHERSLNSFLAALAHATSSAACIRDGRALAIALFNRVCREQSGPRVVPLTVHTYNILMDCCCRASRPDLGLAFFARLLRTGLKTNEITANTFLKCLCYAKRTDEALNVLLHRMSELGCVPDAISYNIVLKSLCEDSMSQWALDLLQMMAKEGGGCSPNVVAYSTVIHGFFKEGETGKACNLFHEMMHQGVEPSVWTYSSIIDALCKARAMDKAELVLQQMVNKGVQPNNVTYNCMIHGYSTSGQWKEAAKLLREMKSRDLIPDIVTRNSFLASLCKHGRSKEAAEFLDSMTAKGHKPDIVSYRILFHGCASEGCFADMIDLFNSMESNGIAADCHVFNILINGYAKRGMTEEAMLIFTEMRGQGVSPDVVTYSIVIAALSRMGRLTDAIEKFNEMTALEVQPDTTVYC

SEQ ID NO: 723 - protein, 469 aa, Triticum aestivum; identical to SEQ ID NO: 722

SEQ ID NO: 724 - protein, 469 aa, Triticum aestivum; identical to SEQ ID NO: 722

SEQ ID NO: 725 - protein, 469 aa, Triticum aestivum; identical to SEQ ID NO: 722

SEQ ID NO: 726 - protein, 534 aa, Triticum aestivum
MSRRFPPGAMSRRILERKIQDRYHAGHIGTHDALNLFDELIQVAGPSSVRAINCLLTVVGRDCPALGVSLFNRVARAKVPPHNITYSILVDCCCRAGRLDLGHAAMGHVIKLGFAAEAIVNFSHLLKAICAEKKTSYAMDIVLRIMPEFNCIPDVFSYSILFKGLCNEKRSQEALELIHIMAEDGGSCQPNVVSYNTVLDGLLKEGEVGKAYSLFCVMLQRGISPNVVTCTSIISGMCKVHAMDKAEEVLQQMTNRGILPNSATYNSLIHGYYSLGQCEEVDRIFKEMSRNGVQPDIVTYNIQMDYLCKSRRCAEARKIFDSMVSLGQKPDVTTYSILLHGYAMEKSFHDMLCLIDLMVGNGIAPNHYVYNILISAYAKEEMVDEVMHIFRKMRQKGLNPDAVSYGTVIHLLSRIGRMDDAMCQFAQIITEGLAPDIIVFNSLISGFCSCGKWEKVHELFSEMLDCGICPDRVFFNTVMDHLCKNGRVMEAQDVFDLMVHMGVKPFVRDYNTLIHGYCLVGKMDEGRKLLDNMF

SEQ ID NO: 727 - protein, 517 aa, Triticum aestivum
MRPCRTPLLDSTSRLSVLLLDHLHRNRPSPPPSPSPPSAFWSPIAAFAAATKRARAGTLSPEDAHHLFDELLRQSIPVPNRFLNSFLAALARAPASDACGDGPALTVALFNRLCREEAGPCVAPPTIYTNNILMDSCCRVGRPDLGLAVFGRLLKSGLKADQITASSLLMCLCDVGRTNEAVDVLLHRISELGCEPNVIPYNIVLKSVCDSRRSQQALDLLQMMAQRGCCSPNVVSYNTVIHGLFKEGEVSMACSLFYEMMRQRVMPNVVTYRSMIGALCKVGATDKAKLVLGHMVGNGFQPDMYTWNSFMASLCKQGRGKEAAQLFDYMVAKGHKPDVVMYSTLLHGYATEGCFTDMINHFNSMEGNGIVANSRVFNILIDAYAKRGMMHEAMLIFTEMRERRVSPDIFTYGIIIAALCRMGRLSDAMEKINEMVATGLQPNEAVYYSLIQGFCTHDDLVKAKELVSEMMTKGIPRPNIVFFNSVIASLCKEGRVKDAHGIFDLAMNIGERPDLIH

SEQ ID NO: 728 - protein, 336 aa, Triticum aestivum
MLLHRMPGDMPDVISYSVIIKSFCDNGRSQRALDLLRMMTKKGSDHSPNVVSYTIIIGGLIKEGELSKACALFHEMMQQGVVPDVVTYSSIIDGLCKARALDEAEVVLRQMIDSGVRPNAVTYGSLIHGYSTSGQFEEVVRLLEEMRGQGVEPNLFTHNTVMDYLCKHGRTKEAAELFYSMAEKGHKPNMVSFSIMLHGYAIEGSLAEMTDLCELMARDGIVPNICIFNILINAYAKCGIMDVAMLFFEDMLKQGVTPDEVTYLAVIAGYCRMGRMDDAIKKFNEMIDMGVPHSLTIYRCMIHGYFRHGNFLKAKELITEMKNKGIRPCPRKKPKN

SEQ ID NO: 729 - protein, 531 aa, Triticum aestivum
MKFSAVPSLVECLTSAGHPPSSGLSSPTRSHIRHCRKEQDLPRLARLSSSSGSSQANQLLNKLKDHLGSGMLRPELAHQLFDKLFPQTVPVSADALNVLFSALACGLPSAACNDGPALAIALFKHMARTRCRQVMAPTNHTYNTLIECCHMARRPDIGPAFFGLLLKTGIMVDVFTFNSLLKCLCDMKQTDEALGVLLHRMPGDMPDVISYSVIIKSFCDNGRSQRALDLLRMMTKKRSDHSPNVVSYTIIIDGLIKEGELSKACALFHEMMQQGVVPDVVTYSSIIDGLCKARALDEADVVLRQMIDSGVRPNVVTYGSLIHGYSTSGQFEEVVRLLEEMRGQGVEPNLFTHNTVMDYLCKHGRTKEAAELFYSMAEKGHKPNMVSFSIMLHGYAIEGSLAEMTDLCELMARDSIVPNICIFNILINAYAKCGIMDVAMLFFEDMLKQGVTPDEVTYLAVIAGYCRMGRMDDAIEKFNEMIDMGVPHSLTIYRCIIHGYFRHGKFLKAKELITEMKNKGIRPCPRKKPKN

SEQ ID NO: 730 - protein, 336 aa, Triticum aestivum; identical to SEQ ID NO: 728

SEQ ID NO: 731 - protein, 336 aa, Triticum aestivum; identical to SEQ ID NO: 728

SEQ ID NO: 732 - protein, 336 aa, Triticum aestivum; identical to SEQ ID NO: 728

SEQ ID NO: 733 - protein, 336 aa, Triticum aestivum; identical to SEQ ID NO: 728

SEQ ID NO: 734 - protein, 336 aa, Triticum aestivum; identical to SEQ ID NO: 728

SEQ ID NO: 735 - protein, 503 aa, Triticum aestivum
MTNRSVTPDVCTYNLLMTSLYKNGNSKEAAQLFYSMATKGLKPDTVSYAILLHGYATEGCLVDMINLFNSMATDCILPNCHIFNILIYAYAKSGKLDKAMLIFKDMQKQGVSPDAVTYSTVIHAFCKKGRLDDAVTKFNQMIDTGVQPEASAYRSLIQGFCTHGDLVKAKEYVTEMMKKGMLPPDIMFFSSIMQKLCTEGRVIEARDILDLIVRIGMRPNVFIFNILIGGYCLGCKMEDATKMFEDMVSFGLEPCNITYGILINGYCKSRRIDDGLILFQEMLHKGLKPTTFNYNVILDGLFLAGRTIAAKEKFDEMVESGVSVCTDTYSIVLAGLCRNNCFSEVIMLFQKLRAMNMKFNIRIVTIIIDAFYKVRRNQEAKDLFAAIPSNGLVANVVTYSIMMKNLIKEGSVEEADTLFLSMEKSGCTANSWMLNHIIRRLLERGEIVKAGNYISKVDAKSYSLEAKTVSLLISLFSGKGKYREHIKLLPMKYQFLEEAATVE

SEQ ID NO: 736 - protein, 305 aa, Triticum aestivum
MTNRSVTPDVCTYNLLMTSLYKNGNSKEAAQLFYSMATKGLKPDTVSYAILLHGYATEGCLVDMINLFNSMATDCILPNCHIFNILIYAYAKSGKLDKAMLIFKDMQKQGVSPDAVTYSTVIHAFCKKGRLDDAVIKFNQMIDTGVRPEASAYRSLIQGFCTHGDLVKAKEYVTEMMKKGMLPPDIMFFSSIMQKLCTEGRVIEARDILDLIVRIGMRPNVFMFNILIGGYCLVCKMEDATKMFEDMVSFGLEPCNITYGILINGYCKNRRIDDGLILFQEMLHKGLKPTTFNYNVILDGLFLAG

SEQ ID NO: 737 - protein, 300 aa, Triticum aestivum
MPQLGVQPNVVIYTSIIDALSKCGAMDKAEVVLQQMVDQGIEPNIRTYTSLIHGYSASGQWKAAARVFKEMVSVGVLPNAVTLNSFMDSLCKHRRTKDARDIFDSMAAKGQKPDIFSYSIMLNGYAKEGYFEDMTDLFNLMVLNGIVPNHHIFNILINAYAKRGLMDEAMHMFEVMRQQGVNPNVVDYVVVMDSLCKMGRMDAALDKFTQMVNQGVSPNKAVYQCLVLGSCSHGHFVKAKELISEAINRGLFSNSVFFYPVINDLCKEGKVKEAQDMFDFILGIGRRPDVIMYNSLMDGY

SEQ ID NO: 738 - protein, 300 aa, Triticum aestivum; identical to SEQ ID NO: 737

SEQ ID NO: 739 - protein, 195 aa, Triticum aestivum
MAAKGQKPDIFSYSIMLNGYAKEGYFEDMTDLFNLMVLNGIVPNHHIFNILINAYAKRGLMDEAMHMFEVMRQQGVNPNVVDYVVVMDSLCKMGRMDAALDKFTQMVNQGVSPNKAVYQCLVLGSCSHGHFVKAKELISEAINRGLFSNSVFFYPVINDLCKEGKVKEAQDMFDFILGIGRRPDVIIYNSLMDGY

SEQ ID NO: 740 - protein, 432 aa, Triticum aestivum
MTTLLPRVSTGTRRGERKGSPRCPLRRPGGTHRRHRAGVGHSPDVFTYSTLVSALCRMGKLADAMDKFSEMIGTGVQPGTVVYHSLIQGFCTHGDLVKAKELVYEMMNKGSPCPNIAFFSSIVDSLCKEGRVMDAHHIFDLVKDIGERPDIIMFNTLIDGYCLVGEMEKACGVFDAMVSAVVEPDVITYSTLVSGYCKSGRIDDGLNLFTEMLHKKVKPTTVTYGTILDGLFCAGRSAAAKKVFHEMIESGIMVSISTYNIILGGLCRNNCADEAIVLFQKLCAMNVKFNITTLNTMLNAFYKVQRREEASDLFAALPASGLVPNASTYGVMIQNLLKEGAVEEADSMFSSMEKSGCAPSSRFLNYIIRTLLEKGEIDKAGKYMSKVDGKTILLEASTTSLLMSLFSRGGKYQEHILLLPAKYQLFSGVNHS

SEQ ID NO: 741 - protein, 432 aa, Triticum aestivum; identical to SEQ ID NO: 740

SEQ ID NO: 742 - protein, 432 aa, Triticum aestivum; identical to SEQ ID NO: 740

SEQ ID NO: 743 - protein, 432 aa, Triticum aestivum; identical to SEQ ID NO: 740

SEQ ID NO: 744 - protein, 416 aa, Triticum aestivum
MHIYAKRGLIDEAVLILTEMRGHGLSPDVFTYSTLVSALCRMGKLADAMDKFSEMIGTGVQPGTVVYHSLIQGFCTHGDLVKAKELVYEMMNKGSPCPNIAFFSSIVDSLCKEGRVMDAHHIFDLVKDIGERPDIIMFNTLIDGYCLVGEMEKACGVFDAMVSAVVEPDVITYSTLVSGYCKSGRIDDGLNLFTEMLHKKVKPTTVTYGTIPDGLFCAGRSAAAKKVFHEMIESGIMVSISTYNIILGGLCRNNCADEAIVLFQKSCAMNVKFNITTLNTMLNAFYKVQRREEASDLFAALPASGLVPNASTYGVMIQNLLKEGAVEEADSMFSSMEKSGCAPSSRFLNYIIRTLLEKGEIDKAGKYMSKVDGKTILLEASTTSLLMSLFSRGGKYQEHILLLPAKYQLFSGVNHS

SEQ ID NO: 745 - protein, 432 aa, Triticum aestivum; identical to SEQ ID NO: 740

SEQ ID NO: 746 - protein, 432 aa, Triticum aestivum; identical to SEQ ID NO: 740

SEQ ID NO: 747 - protein, 225 aa, Triticum aestivum
MVSYGMDEAMHMFEVMRQQGVNPDVFGYQIIMDSLCKMGKMDAALDKFNQMVNQGVSPNKAVYQCLVLGSCSHGDFVKAKELISEAVNRGMCSNSVFFYPVINDLCKEGKVKEAQDMFDFILGIGQRPDVIMYTSLMDGYCLVGKVEKALSVLDAMKFAGLQPDDVVYGTLLNSYCKIGRIADGLSLFRKCHSAGLSPRLLYTTLYWMGCFALGEQVLQRKNSIR

SEQ ID NO: 748 - protein, 225 aa, Triticum aestivum; identical to SEQ ID NO: 747

SEQ ID NO: 749 - protein, 470 aa, Triticum aestivum
  misc_feature (24)..(24): Xaa can be any naturally occurring amino acid
  misc_feature (251)..(252): Xaa can be any naturally occurring amino acid
  misc_feature (349)..(349): Xaa can be any naturally occurring amino acid
MDFTATDVFQHSPYGDILNSLKSXSLSGEPWPNCQAKRSNEALDMLLHRTPELHCAPDVFSYNIVINGCLKEGEVDKACNLFHEMPQLGVQPDVVTYTSIMDALSKSGAMDKAEVLLRQMVDQGIEPNIKTYSYLIHGYSTFGQWKEALRVFKEMASLGVVPDVVTLTSLIDSLCKHRRTKEARESFDSMAAKGLKPNIVSYSTMLNGYVKEGSFEDMTDLFNSMVRNGIVPNHHIFNILINAYAKRGGVXXEAMHMFEVMRQQGVNPDVFDYQIIMDSLCKMGRMDAALDKFNQMVNQGVSPNKAVYQCLVLGSCSHGHFVKAKELISEVVNRGLCSNSVFFYPVINXLCKEGKVKEAQDMFDFILGIGQRPDVIMYTSLMDGYCLVGKVEKALSVLDAMKFAGLQPDDVVYGTLLNSYCKIGRIADGLSLFRKCHSAGLSPRLLYTTLYWMGCFALGEQVLQRKNSIR

SEQ ID NO: 750 - protein, 225 aa, Triticum aestivum; identical to SEQ ID NO: 747

SEQ ID NO: 751 - protein, 509 aa, Triticum aestivum
MGEAELEPRGGGLGLRGDGGRCGRLGGVVVGPGRGAAAVPGARGGGWGWLFFGLLGGRRRRPGGQGSRSGGWLLRQRLQAWRGADPVVRDLPTHQGHASLLLHHANGATPPPPPTRLPPLLLHLSSLTHLGSPRRLRRRRRPRALWQPHRGGRTPPVRRIAAAGQSCPGPPPQQTSLRPRPCSGVRGLRRRPALAVALFSRISQGARRRVAEPTACTYGILMDCCSRACCPELALAFFARLLRSGLRVGVIEVRTLLKGLCHAKRAEEAMDVLLHRMPELGCTPGVVAYNTVINGFFKEGQVGKACSLFHGMPQRGVLPDVVTYTSVVDGLCKARAMDKAEYFLRQMVDSGVVPDNVTYNSLIHGYSSLGHQKEAVRVLKEMNRRVTPDVITCTSLMAFLCKNGKSKEAAEIFDSMATKGLKHDAVSYAILLHGYATEGCLVDMINLFNSMDRDCILPDGRIFNILINAYAKSGNLDKAMLIFKEMQKQGVSPDAVTYSTVIHAFCKKG

SEQ ID NO: 752 - protein, 288 aa, Triticum aestivum
MDCCSRACCPELALAFFARLLRSGLRVGVIEVRTLLKGLCHAKRAEEAMDVLLHRMPELGCTPGVVAYNTVINGFFKEGQVGKACSLFHGMPQRGVLPDVVTYTSVVDGLCKARAMDKAEYFLRQMVDSGVVPDNVTYNSLIHGYSSLGHQKEAVRVLKEMNRRVTPDVITCTSLMAFLCKNGKSKEAAEIFDSMATKGLKHDAVSYAILLHGYATEGCLVDMINLFNSMDRDCILPDGRIFNILINAYAKSGNLDKAMLIFKEMQKQGVSPDAVTYSTVIHAFCKKG

SEQ ID NO: 753 - protein, 509 aa, Triticum aestivum; identical to SEQ ID NO: 751

SEQ ID NO: 754 - protein, 509 aa, Triticum aestivum
  misc_feature (24)..(24): Xaa can be any naturally occurring amino acid
MGEAELEPRGGGLGLRGDGGRCGXLGGVVVGPGRGAAAVPGARGGGWGWLFFGLLGGRRRRPGGQGSRSGGWLLRQRLQAWRGADPVVRDLPTHQGHASLLLHHANGATPPPPPTRLPPLLLHLSSLTHLGSPRRLRRRRRPRALWQPHRGGRTPPVRRIAAAGQSCPGPPPQQTSLRPRPCSGVRGLRRRPALAVALFSRISQGARRRVAEPTACTYGILMDCCSRACCPELALAFFARLLRSGLRVGVIEVRTLLKGLCHAKRAEEAMDVLLHRMPELGCTPGVVAYNTVINGFFKEGQVGKACSLFHGMPQRGVLPDVVTYTSVVDGLCKARAMDKAEYFLRQMVDSGVVPDNVTYNSLIHGYSSLGHQKEAVRVLKEMNRRVTPDVITCTSLMAFLCKNGKSKEAAEIFDSMATKGLKHDAVSYAILLHGYATEGCLVDMINLFNSMDRDCILPDGRIFNILINAYAKSGNLDKAMLIFKEMQKQGVSPDAVTYSTVIHAFCKKG

SEQ ID NO: 755 - protein, 505 aa, Triticum aestivum
MPRVRPGSSSSTVSARANQQLLNKLKDHLDSGTLQPERAHQLFDKLLRQTVPVSACALNGLFASLARALPSAACTDGSALAIALFNRMAREGRRVIAPNIYTYSILIDCCCRSRRPDLGPAFFGFLLKTGIKADIITFTSLFKCLCDMKRIDEAVGVLLHRMPGDMPDVISYSTILKGFCNEGRSQLALNLLQMMVKKGAGHSPNVVSYNMVIDGFFKEGEVSKACNLFHEMKQRGVVPDVWTYNSIIDAMCKARAMDKAKLVLRQMVDSGVQPDIVTYNKLIHGYSISGQFEEVVRLLDKMRSQGVKPTVFTCNTVMDYLCKHGRIKEAAEFFYSMVEKGLKPNIVSYAIMFRGYAKEGSLVEMTDLCELMARDGIVPDLHCFNILINAYAKCGMMDVAIFFFKDMLKQGVNPDEVTYLAVIAGYCRVGMMDDAMENFNEMIGMGVPHNATVYRCMIQGYLNHGDFLKAKELITEMKTKGIHPRPRKSQGYLMTQLFTSMECWS

SEQ ID NO: 756 - protein, 505 aa, Triticum aestivum; identical to SEQ ID NO: 755

SEQ ID NO: 757 - protein, 504 aa, Triticum aestivum
MPRVRPGSSSSTVSARANQLLNKLKDHLDSGTLQPERAHQLFDKLLRQTVPVPASALNGLFAALARALPSAACTDGPALAIALFNRMAREGRRVIAPNIYTYSILIDCCCRSRRPDLGPAFFGFLLKTGIKADIITFTSLFKCLCDMKRIDEAVGVLLHRLPGDMPDVISYSTILKGFCNEGRSQLALNLLQMMVKKGAGHSPNVVSYNMVIDGFFKEGEVSKACNLFHEMKQRGVVPDVWTYNSIIDAMCKARAMDKAKLVLRQMVDSGVQPDIVTYNKLIHGYSISGQFEEVVRLLDKMRSQGVKPTVFTCNTVMDYLCKHGRIKEAAEFFYSMVEKGHKPNIVSYAIMFRGYAKEGSLVEMTDLCELMARDGIVPDLHCFNILINAYAKCGMMDVAILFFKDMLKQGVNPDEVTYLAVIAGYCRVGMMDDAMENFNEMIGMGVPHNATVYRCMIQGYLNHGDFLKAKELITEMKTKGIHPRPRKSQGIDPGYLMTQLFTGA

SEQ ID NO: 758 - protein, 505 aa, Triticum aestivum; identical to SEQ ID NO: 755

SEQ ID NO: 759 - protein, 505 aa, Triticum aestivum; identical to SEQ ID NO: 755

SEQ ID NO: 760 - protein, 504 aa, Triticum aestivum; identical to SEQ ID NO: 757

SEQ ID NO: 761 - protein, 475 aa, Triticum aestivum
MMQQGIVPNVVTYSSIIDALCKVRAMDKAKLVLQQMVDNGVQPDVVTWNSFMYSFCKHGKSKEAAEFFDSMTTKGLKPDIVAYSTLLHGYATEGCLADMINLFNTMEDNGIVANCNVFNILIDAYAKRGMMHEAMLIFTEMQEQRVSLDVCTYATVIAALCRMGRLADAMDKLNEMIAMGLQPNKVVYHSLIQGFCTHSDLVKAKALVSEMMNKGIPRPNIVFFSSVINSLCKEGRVTDAHDIFDLAINIGERPDVITFNSLIDGYCLAGKMDKAFGVLDAMVSAGIEHNVVTYNTLVDGYSRNGRIDDGLTLFREMTRNKIKPTTATYGAILHGLFRAGRTSSAKKMFNEMIESGTTVDIPIYAIILGGLCRNNCVDEAIILFEKLGAMNVKLDVGIFNTMINAVYTVKGREEAKDLFAAISANWLVPNASSYGVMITNLLREGLVEEADNMFSSMDKSGCAPSSRLLNIIIRM

SEQ ID NO: 762 - protein, 475 aa, Triticum aestivum; identical to SEQ ID NO: 761

SEQ ID NO: 763 - protein, 475 aa, Triticum aestivum; identical to SEQ ID NO: 761

SEQ ID NO: 764 - protein, 475 aa, Triticum aestivum; identical to SEQ ID NO: 761

SEQ ID NO: 765 - protein, 475 aa, Triticum aestivum; identical to SEQ ID NO: 761

SEQ ID NO: 766 - protein, 475 aa, Triticum aestivum; identical to SEQ ID NO: 761

SEQ ID NO: 767 - protein, 501 aa, Triticum aestivum
MLRRIRLRRRPYPSCTYPEPVLCHSSSFISAAPLLRLHQYRTTTTPMSRIHLRRRLFSSTTRPSHSWSPHAAFAAATERVRTGALSQDDAHHLFDELLRQATPVPGRSLNGFLAALARAPASGACRDGPALALALFNRVCLDESGARVAPPTIFTYGILMNCCCRAHRPDLGLAFLARLLRTGLKADQIVANTFLKCLCCAKRTDEAVNVLLHRMPRLGCVPNAFSYSIVLKSLCDNGMSRQALDLLHMMAKEGGGCSPNVVAYSTVIHGFFKEGETGKACNLFHEMMQQGVEPNVWTYSSIIDALCKARAMDKAELVLEKMVNKGVQPNNVTYNCMIHGYSTSGQLKEAAKMFREMTSQGLIPDNFTCSSLMTYLCKHGRSKEAAEFFDAMTAKGHRDVISYCILLHGYANEGCFADMIDLFNSMQRNGIAANCHVFNILINGYAKRGMTDEAMLIFTEMWEKGVSPDVVTYSTVIAALSRMGGLTDAMEKFNQMIAMGI

SEQ ID NO: 768 - protein, 490 aa, Triticum aestivum
  misc_feature (45)..(45): Xaa can be any naturally occurring amino acid
  misc_feature (47)..(47): Xaa can be any naturally occurring amino acid
  misc_feature (52)..(52): Xaa can be any naturally occurring amino acid
MWWRIARSSMAFLRRVKQGRHAVYSMTAKGQKPDIISYCTLLHGXAXEGCFXDMIDLFNSMKSNGIAADCRVFTILIDAYAKRGMMDDAMHIFTEMWEKGVSPDVVTYSTVIAALSRMGRLTDAMDKFNQMISMGVQPNTVVYHTLIQGSCMHGDLIKAKELVSEMMNKGIPRPSIAFFGSIINRLCKDGRVMDAHDIFDLVIDIGERPSVITFNSLVDGYCLVGKMDKAFGMLNAMESVGVEPDIVTYSTLLDGYFKNGRINDGLTLFREMPLKRIKPDTVTYGIMLDGCFRAGRTVAARTMFHEMIESGITVDIPTYNIVLRGLCRNNCTDEAIALFQKLGAMSMKFNIAILNTMINAIYKVRRREEANNLFAAISASGLVPNQSTYAVMIINLLKDGAVEHASNMFSSMEKSGIVPSSRLINGIIRLLLENGEIAKAGIYLSKVDGNSISLEASTTSLMLSLFSRKGKYQEDMKLLPAKYQFFGEFG

SEQ ID NO: 769 - protein, 503 aa, Triticum aestivum
MPRVRPGSSSSTVSSRANQLLNKLKDHLGSGTLQPERAHQLFDKLLRQTVPVSAFALNGLFAALARALPSAACTDGPALAIALFNRMAREGRRVIEPNIYTYNILIDCCCRSRHPDLGPAFFGFLLKTGIKADIITFNSLLKCLCDMMQMEEALNMLLYRMPELPDSISYSIIIKSLCDNGRSQCALDLLRMKAKKGADHYPGLVAYNRVINGLIKEGELSKACSLFHEMMQQGVVPNVVTYSSIIDALCKAGAMDKAEVALRQMVGNGVRPDIFTYTSLIHGYSISGQFEEVVRLLEKLRSQGVKPTVFTCNTVMDYLCKHGKIKEAAEFFYSMPEKGHKPNIVSYSIMLYGYAKEGSLVEMTDLCELMARDGIVPDLHCLNILINAYAKCGMMDVAMLFFKDMLKQGVNPDEVTYLAVITGYCRVGMMDDAMEKFNEMIDMGVPRNSTVYRCMIQGYLNHGDFLKAKVLTTEMKTKGIHPRPRKSQRIDSGYLMTQLFTGA

SEQ ID NO: 770 - protein, 503 aa, Triticum aestivum
MPRVRPGSSSSTVSSRANQLLNKLKDHLGSGTLQPERAHQLFDKLLRQTVPVSAFALNGLFAALARALPSAACTDGPALAIALFNRMAREGRRVIEPNIYTYNILIDCCCRSRHPDLGPAFFGFLLKTGIKADIITFNSLLKCLCDMMQMEEALNMLLYRMPELPDSISYSIIIKSLCDNGRSQCALDLLRMKAKKGADHYPGLVAYNRVINGLIKEGELSKACSLFHEMMQQGVVPNVVTYSSIIDALCKAGAMDKAEVALRQMVGNGVRPDIFTYTSLIHGYSISGQFEEVVRLLEKLRSQGVKPTVFTCNTVMDYLCKHGKIKEAAEFFYSMPEKGHKPNIVSYSIMLYGYAKEGSLVEMTDLCELMARDGIVPDLHCLNILINAYAKCGMMDVAMLFFKDMLKQGVNPDEVTYLAVITGYCRVGMMDDAMEKFNEMIDMGVPHNSTVYRCMIQGYLNHGDFLKAKVLTTEMKTKGIHPRPRKSQRIDSGYLMTQLFTGA

SEQ ID NO: 771 - protein, 503 aa, Triticum aestivum; identical to SEQ ID NO: 770

SEQ ID NO: 772 - protein, 503 aa, Triticum aestivum; identical to SEQ ID NO: 770

SEQ ID NO: 773 - protein, 503 aa, Triticum aestivum; identical to SEQ ID NO: 770

SEQ ID NO: 774 - protein, 503 aa, Triticum aestivum; identical to SEQ ID NO: 769

SEQ ID NO: 775 - protein, 303 aa, Triticum aestivum
MDCCCRARRPDLGLALFGRFLGTGLRTNEIVATTFLKCLCCAKRTEEVVKVLLHRMPELGCVPNAISYSIVLKSLCENSMSQQALDLLQMVGKEGGCLRDVVAYNTIIHGFFKEGGIDKACHLFHEMMRQGVVPTVVTYNTVIDALCKAGEMDKAELVFQQMARNGAQPNKVTCNGSKFSSLTDGYCSVGKMDKTFKLLDAMVSVGIEPDAVTYSALLDGYFKNGRIDDGLTLFREMSCKGVKPTTVTYGIILDGLYRAGRTAAAKKMFDQMIKSGITVTVSIYTTPSFPVYKAYFNFFVFPI

SEQ ID NO: 776 - protein, 303 aa, Triticum aestivum; identical to SEQ ID NO: 775

SEQ ID NO: 777 - protein, 303 aa, Triticum aestivum
MDCCCRARRPDLGLALFGRFLGTGLRTNEIVATTFLKCLCCAKRTEEVVKVLLHRMPELGCVPNAISYSIVLKSLCENSMSQQALDLLQMVGKEGGCLRDVVAYNTIIHGFFKEGGIDKACHLFHEMMRQGVVPTVVTYNTVIDALCKAGEMDKAELVFQRMARNGAQPNKVTCNGSKFSSLTDGYCSVGKMDKTFKLLDAMVSVGIEPDAVTYSALLDGYFKNGRIDDGLTLFREMSCKGVKPTTVTYGIILDGLYRAGRTAAAKKMFDQMIKSGITVTVSIYTTPSFPVYKAYFNFFVFPI

SEQ ID NO: 778 - protein, 303 aa, Triticum aestivum; identical to SEQ ID NO: 775

SEQ ID NO: 779 - protein, 504 aa, Triticum aestivum
MPNANGVKMFVISRYTVVLTFLVNFSHLLKAICAEKKTSYAMDIVLRVMPEFNYVPNIFSYNILFKGLCNEKRSQEALELIQIMVEDGGGCRPDVVTYSTVIDGLLKEGEVDQAYSLFSEMLRQGVSPNIVTCNSIISGMCKLHAMDKAEEVLQQMLDRRILPDVTTYTSLIHGYYSLGQCEEVDRVFKEMSRNGVQPNIITYSIQMDYLCKNGRCTEARKIFDSMVSLGQKPDVTTYSILLHGYAMERSFHDIHCLIDLMVENGLSPNNYIYNILISACAKEKMVDEAMHIFTKMRQQGLNPDAVSYGTVIDLLSSFGRMDDAMSLFNKMITEGLAPGIIVFNHLISGFCTCGKWVKVHELFSEMLDRGICPNTVFFNTIMDRLCKNGRVMDAQDLFDLMIHMGVKPDVCTYSTLIGGYLFVGKMDEVRKLLENMCSIGLKPDVVTYSILIDGYSKNGRIDDALVVIREMDGVKPSIITFNIMIGVLLKGSRMEEAKDLFDGI

SEQ ID NO: 780 - protein, 504 aa, Triticum aestivum
  misc_feature (204)..(204): Xaa can be any naturally occurring amino acid
  misc_feature (357)..(357): Xaa can be any naturally occurring amino acid
MPNANGVKMFVISRYTVVLTFLVNFSHLLKAICAEKKTSYAMDIVLRVMPEFNCVPNIFSYNILFKGLCNEKRSQEALELIQIMVEDGGGCRPDVVTYSTVIDGLLKEGEVDQAYSLFSEMLRQGVSPNIVTCNSIISGMCKLHAMDKAEEVLQQMLDRRILPDVTTYTSLIHGYYSLGQCEEVDRVFKEMSRNGVQPNIITYXIQMDYLCKNGRCTEARKIFDSMVSLGQKPDVTTYSILLHGYAMERSFHDIHCLIDLMVENGLSPNNYIYNILISACAKEKMVDEAMHIFTKMRQQGLNPDAVSYGTVIDLLSSFGRMDDAMSLFNKMITEGLAPGIIVFNHLISGFCTCGKWXKVHELFSEMLDRGICPNTVFFNTIMDRLCKNGRVMDAQDLFDLMIHMGVKPDVCTYSTLIGGYLFVGKMDEVRKLLENMCSIGLKPDVVTYSILIDGYSKNGRIDDALVVIREMDGVKPSIITFNIMIGVLLKGSRMEEAKDLFDGI

SEQ ID NO: 781 - protein, 504 aa, Triticum aestivum
MPNANGVKMFVISRYTVVLTFLVNFSHLLKAICAEKKTSYAMDIVLRVMPEFNCVPNIFSYNILFKGLCNEKRSQEALELIQIMVEDGGGCRPDVVTYSTVIDGLLKEGEVDQAYSLFSEMLRQGVSPNIVTCNSIISGMCKLHAMDKAEEVLQQMLDRRILPDVTTYTSLIHGYYSLGQCEEVDRVFKEMSRNGVQPNIITYIIQMDYLCKNGRCTEARKIFDSMVSLGQKPDVTTYSILLHGYAMERSFHDIHCLIDLMVENGLSPNNYIYNILISACAKEKMVDEAMHIFTKMRQQGLNPDAVSYGTVIDLLSSFGRMDDAMSLFNKMITEGLAPGIIVFNHLISGFCTCGKWEKVHELFSEMLDRGICPNTVFFNTIMDRLCKNGRVMDAQDLFDLMIHMGVKPDVCTYSTLIGGYLFVGKMDEVRKLLENMCSIGLKPDVVTYSILIDGYSKNGRIDDALVVIREMDGVKPSIITFNIMIGVLLKGSRMEEAKDLFDGI

SEQ ID NO: 782 - protein, 359 aa, Triticum aestivum
MDKAEEDLQQMHDRRILPDVTTYTSLIHGYYSLGQCEEVDRVFKEMSRNGVQPNIITYSIQMDYLCKNGRCTEARKIFDSMVSLGQKPDVTTYSILLHGYAMERSFHDIHCLIDLMVENGLSPNNYIYNILISACAKEKMVDEAMHIFTKMRQQGLNPDAVSYGTVIDLLSSFGRMDDAMSLFNKMITEGLAPGIIVFNHLISGFCTCGKWVKVHELFSEMLDRGICPNTVFFNTIMDRLCKNGRVMDAQDLFDLMIHMGVKPDVCTYSTLIGGYLFVGKMDEVRKLLENMCSIGLKPDVVTYSILIDGYSKNGRIDDALVVIREMDGVKPSIITFNIMIGVLLKGSRMEEAKDLFDGI

SEQ ID NO: 783 - protein, 504 aa, Triticum aestivum
  misc_feature (204)..(204): Xaa can be any naturally occurring amino acid
MPNANGVKMFVISRYTVVLTFLVNFSHLLKAICAEKKTSYAMDIVLRVMPEFNCVPNIFSYNILFKGLCNEKRSQEALELIQIMVEDGGGCRPDVVTYSTVIDGLLKEGEVDQAYSLFSEMLRQGVSPNIVTCNSIISGMCKLHAMDKAEEVLQQMLDRRILPDVTTYTSLIHGYYSLGQCEEVDRVFKEMSRNGVQPNIITYXIQMDYLCKNGRCTEARKIFDSMVSLGQKPDVTTYSILLHGYAMERSFHDIHCLIDLMVENGLSPNNYIYNILISACAKEKMVDEAMHIFTKMRQQGLNPDAVSYGTVIDLLSSFGRMDDAMSLFNKMITEGLAPGIIVFNHLISGFCTCGKWEKVHELFSEMLDRGICPNTVFFNTIMDRLCKNGRVMDAQDLFDLMIHMGVKPDVCTYSTLIGGYLFVGKMDEVRKLLENMCSIGLKPDVVTYSILIDGYSKNGRIDDALVVIREMDGVKPSIITFNIMIGVLLKGSRMEEAKDLFDGI

SEQ ID NO: 784 - protein, 504 aa, Triticum aestivum
MPNANGVKMFVISRYTVVLTFLVNFSHLLKAICAEKKTSYAMDIVLRVMPEFNCVPNIFSYNILFKGLCNEKRSQEALELIQIMVEDGGGCRPDVVTYSTVIDGLLKEGEVDQAYSLFSEMLRQGVSPNIVTCNSIISGMCKLHAMDKAEEVLQQMLDRRILPDVTTYTSLIHGYYSLGQCEEVDRVFKEMSRNGVQPNIITYSIQMDYLCKNGRCTEARKIFDSMVSLGQKPDVTTYSILLHGYAMERSFHDIHCLIDLMVENGLSPNNYIYNILISACAKEKMVDEAMHIFTKMRQQGLNPDAVSYGTVIDLLSSFGRMDDAMSLFNKMITEGLAPGIIVFNHLISGFCTCGKWVKVHELFSEMLDRGICPNTVFFNTIMDRLCKNGRVMDAQDLFDLMIHMGVKPDVCTYSTLIGGYLFVGKMDEVRKLLENMCSIGLKPDVVTYSILIDGYSKNGRIDDALVVIREMDGVKPSIITFNIMIGVLLKGSRMEEAKDLFDGI

SEQ ID NO: 785 - protein, 403 aa, Triticum aestivum
MSHSFSSSVSSCANELLNELHDHLGFRTLRPELAHQLFDEMLRQPVPVSVRALNDLFVALARAPPSTICTDGPALAIDLFNRMAQAGRRQVIAPTIITYNILIDCCHRACRPDLGHAFFGRLLKTGITMSVITYNSLFMCLCDMRRTKEALNMLLHRMPDDLPNVISYSVILKSFSDSGRSQLALDLLQMMAKKGADHSPDVMSYNIVIDGFFKEGEVSKACDLFQEMIRQGIVPTKVTYISIINALCKARAMDKVEVVLRSMVHNGVQPEAVTYSSMIQGYSTLGQLKEVARLLQVMRSQCCMPNVVTCSSVMDYLCKHGRIKEAEEIFYSMAVNGRKPNVISYSIMLHGYAIEGTLIKMIDLCELMARDGVVPDLRCFNILINAYAKYGMMDVAMLFFEDM

SEQ ID NO: 786 - protein, 403 aa, Triticum aestivum; identical to SEQ ID NO: 785

SEQ ID NO: 787 - protein, 403 aa, Triticum aestivum; identical to SEQ ID NO: 785

SEQ ID NO: 788 - protein, 403 aa, Triticum aestivum; identical to SEQ ID NO: 785

SEQ ID NO: 789 - protein, 403 aa, Triticum aestivum; identical to SEQ ID NO: 785

SEQ ID NO: 790 - protein, 403 aa, Triticum aestivum; identical to SEQ ID NO: 785

SEQ ID NO: 791 - protein, 481 aa, Triticum aestivum
MCKVHAMDKAEEVLQQMLDRRILPDAATYNSLIHGYYLLGQCEEVDRVLKEMCRKSVQPNIVTYYIQMDYLCKSGRCAEARKIFDSMIGLGQKPDVTTYSILLHGYAMEKSFHEMHCLIDLMVENGIAPDHHVYNILISAYAKEERVGEVVHIFTKMRQQGLNPNVANYGVVVNLLCSMGRMDDAMSQYNQMITEGLLPGIILFSQLISGFCTCGKWEKVHELFSEMLDRGIYPDTVFFNTIMDHLCKNGRVMEAQDLFDLMVHMGVKPDVCTYSTLIGGYLFVGKMDEVSKLLDNMVSIGMDPDVITYSILIDGYCKNGRIDDALVVFREMLAGKVKPCIITFNIMIGALLKGGRKEEAKDLFDGIWAKGLVPTVVTYSLMIQKLIEEGSLQESDDLFLSMEKNGCPANSRMLNAIVRRLLQKGEMPRAGTYLSKIDERNFTLEASTTSLLTALASVGKCQEYKGLLPEKYHSFLEQGTD

SEQ ID NO: 792 - protein, 481 aa, Triticum aestivum; identical to SEQ ID NO: 791

SEQ ID NO: 793 - protein, 481 aa, Triticum aestivum; identical to SEQ ID NO: 791

SEQ ID NO: 794 - protein, 481 aa, Triticum aestivum; identical to SEQ ID NO: 791

SEQ ID NO: 795 - protein, 481 aa, Triticum aestivum; identical to SEQ ID NO: 791

SEQ ID NO: 796 - protein, 481 aa, Triticum aestivum; identical to SEQ ID NO: 791

SEQ ID NO: 797 - protein, 482 aa, Triticum aestivum
MSRRFVPVGRRILEQNIKARYHAGDIGTEDALHLFDELLQVAGRSSIHAINCLLTVVCRDCPALGVSLFNRVARSKVAPSSITYAILVDCCCRAGRLDLGHTAMGHIIKTGFAAEAIVNFNHLLKAICAENKTSYAMDIVLRIMPMFNCVPNIFSYSILFKGLCNEKRSQEALELINMMVEDGGSCRPDVVTYNTVIDGLLKEGEVGKAYSLFCEMLRQGVSPDAVTCSSIISGMCKLHAMDKAEEVLQQMLDRRILPNVATYNSLIHGYYLLGQCEEVDRIFKEMSRNGVQPNVVTYNIQMDYLCKSGRCAEARKIFDSMISLGQKPNVYTYSVLLHGYAMEKSFHDMHCLIDLMVENGIAPDHHVYNILISAYAKEEMVGVVMHIFTKMRQQGLNPDAVSYGAVIDLLCSMGRMDDAMSQYNQMITEGLLPGIIVFTPLISGFCSCGKWEKVDELFSEMLDRGICPNSVLQHNYGPPLQK

SEQ ID NO: 798 - protein, 482 aa, Triticum aestivum; identical to SEQ ID NO: 797

SEQ ID NO: 799 - protein, 482 aa, Triticum aestivum; identical to SEQ ID NO: 797

SEQ ID NO: 800 - protein, 482 aa, Triticum aestivum; identical to SEQ ID NO: 797

SEQ ID NO: 801 - protein, 482 aa, Triticum aestivum; identical to SEQ ID NO: 797

SEQ ID NO: 802 - protein, 482 aa, Triticum aestivum; identical to SEQ ID NO: 797

SEQ ID NO: 803 - protein, 490 aa, Triticum aestivum
MSRLHPRYFSSSISSLADELLSELHHHLGSGTLSPQLAHQLFDEMLRQPVPVSSRALNGLFAALARTPPSTTCTDSPALAINLFNRMARAGRGRVIAPSSHTYSILIECCCLARRPDLGPSFFAHLLKTGVTADVVIFSGLFKCLCDMKRADEAQDILLHRIPDDLHDAISYSVILKSFCNNGLSQRALDLLRMMAKKGADHSPGVFAYSMVIHGFFKEGEVSKACDLFHEMIQQGPVPNVVTYNSVIDALCKARAMDKAEVVLRSMVHNGVQPNVVTYNSLIQGYSTVGQLKEVARLLKVMRSQGVMPSVVTYNSLMGYLCKHGRIKEAEEIFFSMTLNGRKPDIVSYSIMLRGYAIEGSLVKMIDLCELMARDGVVPELHCFNILISAYAKYGMMDVAMLFFEDMLKQGLNPGDFIYLTVISAFCKMGRMDDALEKFNEMIDRGVPLDTKIYMCMIEGYLNRGDSVKAEEFITKMKSRDIRHRPRKGN

SEQ ID NO: 804 - protein, 490 aa, Triticum aestivum; identical to SEQ ID NO: 803

SEQ ID NO: 805 - protein, 490 aa, Triticum aestivum; identical to SEQ ID NO: 803

SEQ ID NO: 806 - protein, 490 aa, Triticum aestivum; identical to SEQ ID NO: 803

SEQ ID NO: 807 - protein, 490 aa, Triticum aestivum; identical to SEQ ID NO: 803

SEQ ID NO: 808 - protein, 490 aa, Triticum aestivum; identical to SEQ ID NO: 803

SEQ ID NO: 809 - protein, 296 aa, Triticum aestivum
MAKKGADHSPNVVSYNTVINGFFKEGEVSKACNLFHEMIQQGVVPNEVTYSSIINALCKARAMDKAEVILRHMVHSGVQPHDRIYNILIHGFLTSGQLKEAFRLLKLMTSQGVMPNLVTCNSVMTYHCKNGRVKEAAEIFYSMAVKGRKPNVISYSIMLHGYATEGSLVEMIDLCELMARDGVVPDRSVFNILIKAYAKHGMIDVAMLFFDEMLKQGVNPNDITYLTLISAFCKMGRMDDAMIKFNEMIDMGIPHDTTVYMCMIEGYLNHGDSVKAKEFITKMKSRDVCHSPRKGN

SEQ ID NO: 810 - protein, 296 aa, Triticum aestivum; identical to SEQ ID NO: 809

SEQ ID NO: 811 - protein, 296 aa, Triticum aestivum; identical to SEQ ID NO: 809

SEQ ID NO: 812 - protein, 296 aa, Triticum aestivum; identical to SEQ ID NO: 809

SEQ ID NO: 813 - protein, 259 aa, Triticum aestivum
MIQQGVVPNEVTYSSIINALCKARAMDKAEVILRHMVHSGVQPHDRIYNILIHGFLTSGQLKEAFRLLKLMTSQGVMPNLVTCNSVMTYHCKNGRVKEAAEIFYSMAVKGRKPNVISCSIMLHGYATEGSLVEMIDLCELMARDGVVPDRSVFNILIKAYAKHGMIDVAMLFFDEMLKQGVNPNDITYLTLISAFCKMGRMDDAMIKFNEMIDMGIPHDTTVYMCMIEGYLNHGDSVKAKEFITKMKSRDVCHSPRKGN

SEQ ID NO: 814 - protein, 211 aa, Triticum aestivum
MSRLHPRYFSSSIPSLADELLSELHHHLGSGTLSPQLAHQLFDEMLRQPVPVSSRALNGLFAALARTPPSTTCTDSPALAINLFNRMARAGRGRVIAPSSHTYSILIECCCLARRPDLGPSFFAHLLKTGVTVDVVTFSGLFKCLCDMKRTEEALDVLLHKVPHNLPNVISYSVVVKSFCDNGRSQLALDLLRIMAKKGADHPPTWCHTTR

SEQ ID NO: 815 - protein, 490 aa, Triticum aestivum
MSRLHPRYFSSSIPSLADELLSELHHHLGSGTLSPQLAHQLFDEMLRQPVPVSSRALNGLFAALARTPPSTTCTDSPALAINLFNRMARAGRGRVIAPSSHTYSILIECCCLARRPDLGPSFFAHLLKTGVTVDVVTFSGLFKCLCDMKRTEEALDVLLHKVPHNLPNVISYSVVVKSFCDNGRSQLALDLLRIMAKKGADHSPNVVSYNTVINGFFKEGEVSKACNLFHEMIQQGVVPNEVTYSSIINALCKARAMDKAEVILRHMVHSGVQPHDRIYNILIHGFLTSGQLKEAFRLLKLMTSQGVMPNVVTCNSVMTYHCKNGRVKEAAEIFYSMAVKGRKPNVISYSIMLHGYATEGSLVEMIDLCELMARDGVVPDRSVFNILIKAYAEHGMIDVAMLFFDEMLKQGVNPNDITYLTLISAFCKMGRMDDAMIKFNEMIDMGIPHDTTVYMCMIEGYLNHGDSVKAKEFITKMKSRDVCHSPRKGN

SEQ ID NO: 816 - protein, 296 aa, Triticum aestivum; identical to SEQ ID NO: 809

SEQ ID NO: 817 - protein, 493 aa, Triticum aestivum
MSRLQPRYFSSSVSSRANELLSEFHHHLGSGTLWPELARQLFDQMLRQPVPVSVRALNGLFAALARAPPSTACTNAPALVIDLFNRMAQAGRRQVTAPTIYTYSILIECCHRACRPDLGLAFFGRLLQTGITTDVITYSSLLKCLCDMKRTEEALGVLLHRMPNDLPNVISYSVILKSFCDSGRSQLALDLLRMMAEKGSDHSPSVVSYSVVIDGFFKEGEISKACDLFHEMMQQGVVPDVVMYTSIINALCKARAMDKAEVVLRSMVHNGVQPDAVTYTSLIQGYSTLGQLKEVARLLKVMRSQGVMPDVVTCTLVMDYLCKHGRTKEAQEIFYSMAVNGQKPDIVAYCTMLYGYSIEGSLVDMIDLCELMARDGVVPNLRCFNILINAYAKHGMMDVALLFFEDMLKQGVKPNEFTYLTVISAFCKMGRMDDAMEKFREMIDMGVPVDTEVYMCMIEGYLNHGDSVKAKELITEMKNTDIRHKPWKGNGRT

SEQ ID NO: 818 - protein, 493 aa, Triticum aestivum; identical to SEQ ID NO: 817

SEQ ID NO: 819 - protein, 493 aa, Triticum aestivum; identical to SEQ ID NO: 817

SEQ ID NO: 820 - protein, 493 aa, Triticum aestivum; identical to SEQ ID NO: 817

SEQ ID NO: 821 - protein, 493 aa, Triticum aestivum; identical to SEQ ID NO: 817

SEQ ID NO: 822 - protein, 493 aa, Triticum aestivum; identical to SEQ ID NO: 817

SEQ ID NO: 823 - protein, 378 aa, Triticum aestivum
MPPRSWPAFFGRLLKTGITKDVVTYSSLFKCLCDMKRTEEALNVLLHKMPDDLPNVISYSVILKSFCDSGRSQLALDLLRMMAEKGSGHSPSVVSYSMVIDGFFKEGEISKACDLFHEMIQHGVVPTVVTYNSIIDARCKARAMDKAEVVLRSMVHNGVQPDAVTYNCLIQGYSTLGQLKEVARLLKVMRSQGVLPDVVTYNSLMTCLCKNGRLKEAVVFFYSMAMNGQKPDVISYSVLLHGYAKEGSLIDMIDLCERMARDGVVPNLHCFNILISAYAKYGRMDVAMLFFEDMLKKGLNPNEFIYLTVISAFCKMGRMDDALEKFNEMIDRGVPLDIKIYMCMIEGYLNHGDSVKAEEFITKMKSRDIHHRPRKGNC

SEQ ID NO: 824 - protein, 378 aa, Triticum aestivum; identical to SEQ ID NO: 823

SEQ ID NO: 825 - protein, 378 aa, Triticum aestivum
MPPRSWPAFFGRLLKTGITKDVVTYSSLFKCLCDMKRTEEALNVLLHKMPDDLPNVISYSVILKSFCDSGRSQLVLDLLRMMAEKGSGHSPSVVSYSMVIDGFFKEGEISKACDLFHEMIQHGVVPTVVTYNSIIDARCKARAMDKAEVVLRSMVHNGVQPDAVTYNCLIQGYSTLGQLKEVARLLKVMRSQGVLPDVVTYNSLMTCLCKNGRLKEAVVFFYSMAVNGQKPDVISYSVLLHGYAKEGSLIDMIDLCERMARDGVVPNLHCFNILISAYAKYGRMDVAMLFFEDMLKKGLNPNEFIYLTVISAFCKMGRMDDALEKFNEMIDRGVPLGIKIYICMIEGYLNHGDSVKAEEFITKMKSRGIRHRPRKGNC

SEQ ID NO: 826 - protein, 491 aa, Triticum aestivum
MSRLQVRSLSSSFSSRAYELLNELDGRLGSGTLSPEPARELFDEMLRQPVPVSVRALNGLFAALSRAPPSTIYTNAPALAIDLFNRMAQAGRRQVTAPDIYTYNILIDCCHRACRPDLGPAFFGRLLKTGITKDVVTYSSLFKCLCDMKRTEEALNVLLHKMPDDLPDAISYSVILKSFCDSGRSQLALDLLRMMTEKGSGHSPSVVSYSMVIDGFFKEGEISKACDLFHDMIQHGVVPTVVTYNSIIDARCKARAMDKAEVVLRSMVHNGVQPDAVTYNCLIQGYSTLGQLKEVARLLKVMRSQGVLPDVVTYNSLMTCLCKNGRFKEAVEIFYSMAVNGQKPDVISYSVLLHGYAKEGSLVDMIDLCERMARDGVVPNLHCFNILISAYAKYGRMDVAMLFFEDMLKKGLNPNEFIYLTVISAFCKMGRMDDALEKFNEMIDRGVPLDIKIYMCMIEGYLNHGDSVKAEEFITKMKSRDIRHRPRKGNC

SEQ ID NO: 827 - protein, 378 aa, Triticum aestivum; identical to SEQ ID NO: 823

SEQ ID NO: 828 - protein, 378 aa, Triticum aestivum; identical to SEQ ID NO: 823

SEQ ID NO: 829 - protein, 378 aa, Triticum aestivum; identical to SEQ ID NO: 825

SEQ ID NO: 830 - protein, 490 aa, Triticum aestivum
MSRLQVRSYSSPVSSRANDLLTELHGHMGFGTLRPELAHQLFDEMLGQPVPVSVRALNGLFAALARAPPSTACTDGPALAVDLFNHMARAGRRWMTAPTIHTYNILIDCCHRACRPDLGPAFFGCLLKTGVTTSPITYSSLFKCLCDMKRTEEALDILLHRIADDLPNVISYSVILKSFCDNGRSQLALDLLRVMAKKGGDRSPDVMLYNMVIDGFFKEGEVSKACDLFHEMIQQGVVPTEVTYSSIINALCKARAMDKAEVVLRHMVHNGVQPDVVTYTSLIKGYSTLGQLKEVARLLKVMRSQGVMPGIVTYTLVMDYLCKHGRIKEAEEIFYSMAVNGQKRDTVSYSIMLHGYAIEGSLVQMIDLCELMARDGVVPDLRCFNILINAYAKYGMMDAAMLFFEDMLKQGVKPNEFTYLTVISAFCKMGRMDDAMEKFNEMIDMGVPLDTEVYMCMVEGYFNLDDSIKAKEFITKLKNRDIHHRPRKGN

SEQ ID NO: 831 - protein, 490 aa, Triticum aestivum; identical to SEQ ID NO: 830

SEQ ID NO: 832 - protein, 490 aa, Triticum aestivum; identical to SEQ ID NO: 830

SEQ ID NO: 833 - protein, 490 aa, Triticum aestivum; identical to SEQ ID NO: 830

SEQ ID NO: 834 - protein, 490 aa, Triticum aestivum; identical to SEQ ID NO: 830

SEQ ID NO: 835 - protein, 490 aa, Triticum aestivum
MSRLQVRSYSSPVSSRANDLLTELHGHMGFGTLRPELAHQLFDEMLGQPVPVSVRALNGLFAALARAPPSTACTDGPALAVDLFNHMARAGRRWMTAPTIHTYNILIDCCHRACRPDLGPAFFGCLLKTGVTTSPITYSSLFKCLCDMKRTEEALDILLHRIADDLPNVISYSVILKSFCDSGRSQLALDLLRVMAKKGGDRSPNVMSYNMVIDGFFKEGEVSKACDLFHEMIQQGVVPTEVTYSSIINALCKARAMDKAEVVLRHMVHNGVQPDVVTYTSLIKGYSTLGQLKEVARLLKVMRSQGVMPDIVTYTLVMDYLCKHGRIKEAEEIFYSMAVNGQKRDTVSYSIMFHGYAIEGSLVQMIDLCELMARDGVVPDLRCFNILINAYAKYGMMDAAMLFFEDMLKQGVKPNEFTYLTVISAFCKMGRMDDAMEKFNEMIDMGVPLDTEVYMCMVEGYFNLDDSIKAKEFITKLKNRDIHHRPRKGN

SEQ ID NO: 836 - protein, 234 aa, Triticum aestivum
MDKAEVVLRSMVHNGAQPDAVTYNSLIQGYSTLGQLKEVARLLKVMRSQGVMPSVVTCNSLMTCLCKNGRFKEAVEFFYSMAVNGQKPDVISYSVLLHGYAKEGSLIDMIDLCERMARDGVVPDLHCFNILISAYAKYGRMDVAMLFFEDMLKKGLNPNEFIYLTVISAFCKMDRMDDALEKFNEMIDRGVPLDTKIYMCMIEGYLNHGDSVKAEEFITKMKSRDIRHRPWKGN

SEQ ID NO: 837 - protein, 404 aa, Triticum aestivum
MARAGRRQATAPTIYTYSILMECCHRACRPDLGLAFFGRLLKTGIPTNIIDYSSLFKCLCDMKRTEEALNVLLHKMPDDLPNVISYSVILKSFCDNGRSQLALDLLQMMAKKGADHSPDVMSYNMVIDGFFKEGEVSKACDLFQEMIRQGIVPTEVTYSSIINALCKARAMDKAEVVLRSMVHNGAQPDAVTYNSLIQGYSTLGQLKEVARLLKVMRSQGVMPSVVTCNSLMTCLCKNGRFKEAVEFFYSMAVNGQKPDVISYSVLLHGYAKEGSLIDMIDLCERMARDGVAPDLHCFNILISAYAKYGRMDVAMLFFEDMLKKGLNPNEFIYLTVISVFCKMGRMDDALEKFNEMIDRGVPLDTKIYMCMIEGYLNHGDSVKAEEFITKMKSRDIRHRLWKGN

SEQ ID NO: 838 - protein, 267 aa, Triticum aestivum
MSRFQVRSFSSSVSSRAHELLDELHDHLGFRTLRPELAHQLFDEMLRQPVPVSARALSGLFAALARAPPSPACTDSPALAIDLFNRMARAGRRQATAPTIYTYSILMECCHRACRPDLGLAFFGRLLKTGIKMDGITYSSLFKCLCDMKRTEEALNVLFHKMPDDLPNVISYSVILKSLCDNGRSQLALDLLQMMAKKGADHSPDVMSYNMVIDGFFKEGEVSKACDLFQEMIRQGIVPTEVTYSSIINALCKARGQGRGGSSINGS

SEQ ID NO: 839 - protein, 240 aa, Triticum aestivum
MRYAKQEDKAEVVLRSMVHNGAQLDAVTYNSLMQGYSTLGQLKEVARLLKVMRSQGVMPSVVTYNSLMTCLCKNGRFKEAVEFFYSMAVNGQKPDVISYSVLLHGYAKEGSLIDMIDLCERMARDGVVPDLHCFNILISAYAKYGRMGVAMLFFEDMLKKGLNPNEFIYLTVISAFCKMGRMDDALEKFNEMIDRGVPLDTKNYMCMIEGYLNHGDSVKAEEFITKMKSRDIRHRPWKGN

SEQ ID NO: 840 - protein, 267 aa, Triticum aestivum
MSRFQVRSFSSSVSSRAHELLDELHDHLGFRTLRPELAHQLFDEMLRQPVPVSARALSGLFAALARAPPSPACTDSPALAIDLFNRMARAGRRQATAPTIYTYSILMECCHRACRPDLGLAFFGRLLKTGIKMDVITYSSLFKCLCDMKRTEEALNVLFHKMPDDLPNVISYSVILKSLCDNGRSQLALDLLQMMAKKGADHSPDVMSYNMVIDGFFKEGEVSKAWDLFQEMIRQGIVPTEVTYSSIINALCKARGQGRGGSSINGS

SEQ ID NO: 841 - protein, 404 aa, Triticum aestivum
MARAGRRQATAPTIYTYSILMECCHRACRPDLGLAFFGRLLKTGIPTNIIDYSSLFKCLCDMKRTEEALNVLLHKMPDDLPNVISYSVILKSFCDNGRSQLALDLLQMMAKKGADHSPDVMSYNMVIDGFFKEGEVSKACDLFQEMIRQGIVPTEVTYSSIINALCKARAMDKAEVVLRSMVHNGAQPDAVTYNSLIQGYSTLGQLKEVARLLKVMRSQGVMPSVVTCNSLMTCLCKNGRFKEAVEFFYSMAVNGQKPDVISYSVLLHGYAKEGSLIDMIDLCERMARDGVVPDLHCFNILISAYAKYGRMDVAMLFFEDMLKKGLNPNEFIYLTVISAFCKMGRMDDALEKFNEMIDRGVPLDTKIYMCMIEGYLNHGDSVKAEEFITKMKSRDIRHRPWKGN

SEQ ID NO: 842 - protein, 490 aa, Triticum aestivum
MSQFQVRSFSSSVSSRAHELLDELHDHLGFRTLRPELAHQLFDEMLCQPVPVSARALSGLFAALARAPPSPACTDSPALAIDLFNRMARAGRRQATAPTIYTYSILMECCHRACRPDLGLAFFGRLLKTGIKTDVITYSSLFKCLCDMKRTEEALNVLFHKMPDDLPNVISYSVILKSFCDNGRSQLALDLLQMMAKKGADHSPDVMSYNMVIDGFFKEGEVSKACDLFQEMIRQGIVPTEVTYSSIINALCKARAMDKAEVVLRSMVHNGAQPDAVTYNSLIQGYSTLGQLKEVARLLKVMRSQGVMPSVVTCNSLMTCLCKNGRFKEAVEFFYSMAVNGQKPDVISYSVLLHGYAKEGSLIDMIDLCERMARDGVVPDLHCFNVLISAYAKYGRMDVAMLFFEDMLKKGLNPNEFIYLTVISAFCKMGRMDDALEKFNEMIDRGVPLDTKIYMCMIEGYLNHGDSVKAEEFITKMKSRDIRHRPWKGN

SEQ ID NO: 843 - protein, 267 aa, Triticum aestivum; identical to SEQ ID NO: 838

SEQ ID NO: 844 - protein, 267 aa, Triticum aestivum; identical to SEQ ID NO: 838

SEQ ID NO: 845 - protein, 240 aa, Triticum aestivum; identical to SEQ ID NO: 839

SEQ ID NO: 846 - protein, 267 aa, Triticum aestivum; identical to SEQ ID NO: 838

SEQ ID NO: 847 - protein, 267 aa, Triticum aestivum; identical to SEQ ID NO: 840

SEQ ID NO: 848 - protein, 260 aa, Triticum aestivum
MSRLQVRSFSSPVSSRANDLLTELHAHLGFGTLRPELAHQLFDEMLRQPVPVSARALSGLFAALARAPPSTACTDGPALAIDLFNHMARAGRRWMTAPTIHTYNILIDCCHRACRPDLGPAFFSRLLKTGITMSVITYSSLFKCLCDMKRTEEALGVLLHRMPDELPDVISYSVILKSFCDSGRSQLALDLLRMMAEKGSDHSPSVVSYSVVIDGFFKEGEISKACDLFHEMMQQGVVPDVVMYTSIINALCKARAMDKA

SEQ ID NO: 849 - protein, 490 aa, Triticum aestivum
MSRLQVRSFSSPISSRANDLLTELHGHLGFGTLRPELAHQLFDEMLRQPVPVSARALNGLFAALARAPPSTACTDGPALAVDLFNHMARAGRRWMTAPTIHTYNILIDCCHRACRPDLGPAFFSRLLKIGITMSVITYSSLFKCLCDMKRTEEALGVLLHRMPDDLPDVISYSVILKSFCDSGRSQLALDLLRMMAEKGSDHSPSVVSYSVVIDGFFKEGEISKACDLFHEMMQQGVVPDVVMYTSIINALCKARAMDKAEVVLRSMVHNGVQPDAVTYNSLIQGYSTLGQLKELARLLKVMRSQGVMPSVVTYNSLMTCLCKNGRFKEAVEIFYLMAMKGQKPDLISYSILLHGYAKEGSLIDMIDLCEQMARDGVVPDLHCFNILISAYAKYGRMDVAMLFFEDMLKKGLNPNEIIYLTVISAFCKMGRMDDALEKFNEMIDRGVLLDTKIYMCMIEGYLNHGDSVKAEEFITKMKSRDIRHRPRKGN

SEQ ID NO: 850 - protein, 484 aa, Triticum aestivum
MSRLQPRSFSSPVSSRVSELLDEFKCHLGSGTLWPELAHQLFDEMLRQPVPVSARALGGLFSALARARPSTACTDGPALAIDLFNRHRIAPDIYTYNILIDCCHRACRPDLGPAFFGCLLKTGITTDVITYSSLLQCFCDMKRTEEALDLLLHIVSDNLPDAISYSVILKSFCDNGRSQCALDLLQMMAKKGADHSPNVVSYNLVINGFFKEGEISKACDLFHEMIQQGFVPDVVTYNSVINALCKARAMDKAEVVLRSMVHNSVQPDVVTYNSLIQGFLTTGQLKEAFRLLKVMRSQGVMPSVVTCTSVMDYLCKHGRIKEAEETFYSMAASGRKPDTVSYSIMLLGYAIEGSLVKMIDLCEMMARDGVVPDLRCFNILIKAYAKYGRMDVAMLFFEDMLKQGVKPNEFTYLTVISAFCKMGRMDDAMEKFNEMIDMGVSLDTEVYMCMVEGYFNHGDSMKAEEFITKMKNRDIHHKPWKGNR

SEQ ID NO: 851 - protein, 484 aa, Triticum aestivum
MSRLQPRSFSSPVSSRVSELLDEFKYHLGSGTLWPELAHQLFDEMLRQPVPVSARALGGLFSALARARPSTACTDGPALAIDLFNRHRIAPDIYTYNILINCCHRACRPDLGPAFFGCLLKTGITTDVITYSSLLQCFCDMKRTEEALDLLLHRVSDNLPDAISYSVILKSFCDNGRSQCALDLLQMMAKKGADHSPNVVSYNLVINGFFKEGEISKACDLFHEMIQQGFVPDVVTYNSVINALCKARAMDKAEVVLRSMVHNSVQPDVVTYNSLIQGFLTTGQLKEAFRLLKVMRSQGVMPSVVTCTSVMDYLCKHGRIKEAEETFYSMAVSGRKPDTVSYSIMLLGYAIEGSLVKMIDLCEMMARDGVVPDLRCFNILIKAYAKYGRMDVAMLFFEDMLKQGVKPNGFTYLIVISAFCKMGRMDDAMEKFNEMIDMGVPLDTEVYMCMVEGYFNHGDSMKAEEFITKMKNRDIHHKPWKGNR

SEQ ID NO: 852 - protein, 484 aa, Triticum aestivum; identical to SEQ ID NO: 851

SEQ ID NO: 853 - protein, 484 aa, Triticum aestivum
MSRLQPRSFSSPVSSRVSELLDEFKYHLGSGTLWPELAHQLFDEMLRQPVPVSARALGGLFSALARARPSTACTDGPALAIDLFNRHRIAPDIYTYNILINCCHRACRPDLGPAFFGCLLKTGITTDVITYSSLLQCFCDMKRTEEALDLLLHRVSDNLPDAISYSVILKSFCDNGRSQCALDLLQMMAKKGADHSPNVVSYNLVINGFFKEGEISKACDLFHEMIQQGFVPDVVTYNSVINAPCKARAMDKAEVVLRSMVHNSVQPDVVTYNSLIQGFLTTGQLKEAFRLLKVMRSQGVMPSVVTCTSVMDYLCKHGRIKEAEETFYSMAVSGRKPDTVSYSIMLLGYAIEGSLVKMIDLCEMMARDGVVPDLRCFNILIKAYAKYGRMDVAMLFFEDMLKQGVKPNGFTYLIVISAFCKMGRMDDAMEKFNEMIDMGVPLDTEVYMCMVEGYFNHGDSMKAEEFITKMKNRDIHHKPWKGNR

SEQ ID NO: 854 - protein, 484 aa, Triticum aestivum; identical to SEQ ID NO: 851

SEQ ID NO: 855 - protein, 484 aa, Triticum aestivum; identical to SEQ ID NO: 851

SEQ ID NO: 856 - protein, 484 aa, Triticum aestivum; identical to SEQ ID NO: 851

SEQ ID NO: 857 - protein, 298 aa, Triticum aestivum
MSRRFPPGAMSRRILERKIQDRYRAGHIGTDDALNLFDELIQVAGPSSVRAINCLLTVVGRDCPALGVSLFNRVARAKVPPHNITYGILVDCCCRAGRLDLGHAAMGHVIKLGFTAEAIVNFSHLLKAICAEKKTSYAMDIVLRIMPEFNCVPNIFSYNILFKGLCNERRSQEAVELINIMVEDGRGCCRPDVVTYNTVIDGLLKEGEVGKAYSLFCEMPQRGISPDDVTWNSIISGMCKVHAMDKAEDVLEQMLDRGILPDVTTYNSLIHGYYSLGQCEEVDRISRKCLEMVFNQIL

SEQ ID NO: 858 - protein, 475 aa, Triticum aestivum
MAVCAEKKTSYGMDIVLRIMPELNCIPDVYSYSILFKGLCNEKRSQEALELIHMMVEHGGSCQPNLVSYNTVIDGLLKEGEVGKAYSLFCEMVQRGISPNIVTYNSIISGMCKVHATDKAEKVLQQMFDREFLPDTATYTSLIHGYYSSGQCKEVEQVFEHMSINGVQPNMITYNIQMDYHCKSGRCTEARKIFDSMVSLGQKPSVSTYSILLHGYAIEKSFHDMHCLLDLMVENGISPDHHVYNILISAYAKEEMASEVMHIFTKMRQQGLNPSVANYGAVINLLSSIGRMDDAMSQFNQMIAEGLAPDIIVFNPLISGFCTCGKWEKVHELFSEMLNRGIYPDTVFFTTIMDRLCKNGRVMEAQDMFDLMVHMGVKPNVHAYATLMHGYFFVRKMDEVRKLLGNMLSIGLKPDVFIYTILIDGYSKNGMIDNASAVFTEMLEKNIKPSAITYSTMLYGLFHAGLLLPLNYISG

SEQ ID NO: 859 - protein, 357 aa, Triticum aestivum
MDCSCRAHRLDLAFAFFGRLLRTGLKAGVIEVNSLLKGLCHAKRADEAMEVLLHRMPELFIGVQGTAVYRSLIQGFCTHGDLVKAKEYVTEMMKKGMPPPDIMFFSSIMQNLCTEGRVIEARDILDLIVRIGMRPDVFIFNILIGGYCLVGKMEDASKIFDDMVSYGLEPCNFTYGILINGYCKNKRIDDGLILFKEMLRKGLKPTTFNYNVILDGLFLAGQTVAAKEKFDEMVESGVSVCIDTYSIVLGGLCRNSCSSEAITLFRKLSAMNVKFNITIVNTIIGAFYRVERNQEAKDLFAAIPASGLVPNVLTYTIMIKNLIKEGSVEEANNLFLSMEKSGCSANSYLLNHIIRRC

SEQ ID NO: 860 - protein, 446 aa, Triticum aestivum
MLRQPVPISARALNGLFVALARAPPSTACTNASALAIDLFNRMAQAGRRQVTAPTIYTYNILIDCCHRACCPDLGPAFFGRRLKTGIPTDIITYSNLFKCLCDMKRTEEALGVLLHRMPDDLPDVISYSVILKSLCDNGRCQLALDLLRMIAEKGSDHSPSVVSYSMVIDGFFKEGEISKACDLFHEMMQQGVVPDVVTYSSVIDALCKARAMDKAEVVLRSMVHNGVQPDAVTYNCLIQGYSTLGQLKEVARLLKVMRSQGVMPSVVTYTSLMDYLCKHGRIKEAEEIFYSMAVNGRKPDIVSYSIMLRGYAIEGSLIDMIHLCELMARNGVVPDLYCFNILINACAKHGMMDVALLFFEDMLKQGVKPNEFTYLTVISAFCKMGRMDDAMEKFREMIDMGVPVDTEVYMCMVEGYFKNGDSVKAKDFITKMKNKDISNRPQKGN

SEQ ID NO: 861 - protein, 446 aa, Triticum aestivum; identical to SEQ ID NO: 860

SEQ ID NO: 862 - protein, 446 aa, Triticum aestivum; identical to SEQ ID NO: 860

SEQ ID NO: 863 - protein, 446 aa, Triticum aestivum; identical to SEQ ID NO: 860

SEQ ID NO: 864 - protein, 446 aa, Triticum aestivum; identical to SEQ ID NO: 860

SEQ ID NO: 865 - protein, 446 aa, Triticum aestivum; identical to SEQ ID NO: 860

SEQ ID NO: 866 - protein, 477 aa, Triticum aestivum
MSRLQPRSSRANELLDEFKYHLGSGTLWPELAHQLFDELLRQPVPVSARALNGLFAALADAPPSANCADGPALAINLFNRHRISPNIYTYNILIECCHRACRPDLGPAFFGRLLKAGITMSVITYNSLFKCLCDMKRTEEASDVLLHRMPDDLPDVISYSVILKSFCDSGRSQRALDLLRVMAKKGGDYSPNVISYNMVMDGFFKEGEVSKARVLFHEMIQQGVVPTEVTYSSIINALCKARAMDKAEVILRHMVRSGVQPHDRIYNTLIHGFLTSGQLKEAFRLLKLMTSQGVMPSVVTYNSLMTYLCKNGRFKEAVELFYSMAVKGQKPSVVSYSIILHGYAIEGSLVKMIDLCELMARDGVVPNLHCFNILINAYAKYGMMDVAMLFFEDMLKQGVKPNEFTYLTVISAFCKMGRMDDAMEKFSEMINMGVPLDTEVYMCMVEGYLNLGNSMKAKEFITKMKNRDIHHRPRKGN

SEQ ID NO: 867 - protein, 477 aa, Triticum aestivum; identical to SEQ ID NO: 866

SEQ ID NO: 868 - protein, 477 aa, Triticum aestivum; identical to SEQ ID NO: 866

SEQ ID NO: 869 - protein, 477 aa, Triticum aestivum; identical to SEQ ID NO: 866

SEQ ID NO: 870 - protein, 477 aa, Triticum aestivum; identical to SEQ ID NO: 866

SEQ ID NO: 871 - protein, 477 aa, Triticum aestivum; identical to SEQ ID NO: 866

SEQ ID NO: 872 - protein, 404 aa, Triticum aestivum
MARAGRHWMTAPTIHTYNILIDCCHRACRPDLGPAFFSRLLKTGITMSVITYSSLFKCLCDMKRTEEALGVLLHRMPDDLPDVISYSVILKSFCDSGRSQLALDLLRMMAEKGSDHSPSVVSYSVVIDGFFKEGEISKACDLFHEMMQQGVVPDVVMYTSIINALCKARAMDKAEVVLRSMVHNGAQPDAVTYNSLIQGYSTLGQLKDVVRLLKVMRSQGVMPSVVTYTSLMDCLCKHGRIKEAEEIFYSMAVNGQKPDIVSYSIMLRGYAIEGSLVDMIDLCELMARNGVVPDLQFFNIVINAYAKHGMMDVALLFFEDMLKQGVKPNEFTYLTVISAFCKMGRMDDAVEKFREMIDMGVPVDTEVYMCMVEGYFKNGDSVKAKDFITKMKNKDIPNRPQKGN

SEQ ID NO: 873 - protein, 456 aa, Triticum aestivum
MCKVQAMDEAEEVLQQMFDTGILPNITTYNSLIHGYYSSGQCEQVAHIFKKMSRNGVQPDIATYTIQMDYLCKSRRFAGARTIFDSMAGKDQKPNVTSYSILLHAYAMEQSVHDMHCLIELMVENGIAPNHSVYNILIVAYAKGKMFDEVMHIFTKMRQQGLNPNAASYGTVINLLCSIGRMDDAMLQFNQMITEELAPDIIVFNTLISGFCSCGKWEKVHELLAEMLNRGIYPDNVFFNTIMDHLCKNGRVMESQDLADLMIHMGLKPDMHTYNTLMGGYFFIGKMDEVRKLLDHMVSIGMEPDVVTYNTLIDGYFKNGMIDDALAIFSEMLDKKVKPCVITYNTVLHGLFHTGRTVAANELYLRMIDSGICVDIVTYNIILSGLCRNNCVDEALRMFQNLCSTNYQLEIRTYNIMISALLKVGRKEEATGLLDGISAKGFVLDAVTYRLMIQSF

SEQ ID NO: 874 - protein, 275 aa, Triticum aestivum
MDDAMLQFNQMITEELAPDIIVFNTLISGFCSCGKWEKVHELLAEMLNRGIYPDNVFFNTIMDHLCKNGRVMESQDLADLMIHMGLKPDVHTYNTLMGGYFFIGKMDEVRKLLDHMVSIGMELDVVTYNTLIDGYFKNGMIDDALAVFSEMLDKKVKPCAITYNTVLHGLFHTGRTVAANELYLRMIDSGICVDIVTYNIILSGLCRNNCVDEALRMFQNLCSTNYQLETRTYNIMISALLKVGRKEEATGLLDGISAKGFVPDAVTYRLMIQSF

SEQ ID NO: 875 - protein, 275 aa, Triticum aestivum; identical to SEQ ID NO: 874

SEQ ID NO: 876 - protein, 305 aa, Triticum aestivum
MFDTGILPNITTYNSLIHGYYSSGQCEEVAHIFKKMSRNGVQPDIATYTIQMDYLSKSRRFAEARTIFDSMAGKDQKPNVTSYSILLHAYAMEQSVHDMHCLIELMVENGIAPNHSVYNILIVAYAKGKMFDEVMHIFTKMRQQGLNPNAASYGTVINLLCSIGRMDDAMLQFNQMITEELAPDIIVFNTLISGFCSCGKWEKVHELLAEMLNRGIYPDNVFFNTIMDHLCKNGRVMESQDLADLMIHMGLKPDMHTYNTLMGGYFFIGKMDEVRKLLDHMVSIGMEPDVVTYNTLIDGYFKNGM

SEQ ID NO: 877 - protein, 275 aa, Triticum aestivum; identical to SEQ ID NO: 874

SEQ ID NO: 878 - protein, 456 aa, Triticum aestivum; identical to SEQ ID NO: 873

SEQ ID NO: 879 - protein, 275 aa, Triticum aestivum; identical to SEQ ID NO: 874

SEQ ID NO: 880 - protein, 230 aa, Triticum aestivum
MLNRGIYPDNVFFNTIMDHLCKNGRVMESQDLADLMIHMGLKPDMHTYNTLMGGYFFIGKMDEVRKLLDHMVSIGMEPDVVTYNTLIDGYFKNGMIDDALAIFSEMLDKKVKPCVITYNTVLHGLFHTGRTVAANELYLRMIDSGICVDIVTYNIILSGLCRNNCVDEALRMFQNLCSTNYQLEIRTYNIMISALLKVGRKEEATGLLDGISAKGFVLDAVTYRLMIQSF

SEQ ID NO: 881 - protein, 456 aa, Triticum aestivum; identical to SEQ ID NO: 873

SEQ ID NO: 882 - protein, 456 aa, Triticum aestivum; identical to SEQ ID NO: 873

SEQ ID NO: 883 - protein, 275 aa, Triticum aestivum; identical to SEQ ID NO: 874

SEQ ID NO: 884 - protein, 456 aa, Triticum aestivum; identical to SEQ ID NO: 873

SEQ ID NO: 885 - protein, 204 aa, Triticum aestivum
MCKVQAMDKAEEVLQQMFDTGILPNITTYNSLIHGYYSSGQCEEVAHIFKKMSRNGVQPDIATYTIQMDYLSKSRRFAEARTIFDSMAGKDQKPNVTSYSILLHAYAMEQSVHDMHCLIELMVENGIAPNHSVYNILIVAYAKGKMFDEVMHIFTKMRQQGLNPNAASYGTVINLLCSIGRMDDAMLQFNQMITEELAPDSASF

SEQ ID NO: 886 - protein, 275 aa, Triticum aestivum; identical to SEQ ID NO: 874

SEQ ID NO: 887 - protein, 359 aa, Triticum aestivum
MPTARLSSLSTSSFKAPSRERRAPLAALAAATERVREGTLSRQDAHHLFDELLGQAAAVPERGLNNFLAALARAPPSSACSDGPGLAIALFNRMSQGAGARVVSPTLCTYSILMDCCCRAGRPDLVVAFFGRLIRLGLRLEVISFSNLLKGLCKAKRSNEALDLLLHRMPELDCAPDVFSYSIVINGCFKEGEVDKACNLFHEMIQLGVQPNVAIYTSIIDALSKCGAMDKAEVVLRQMVDQGIGPNIRTYTSLIHGYSASGQWKEAVRLFKKMIRLGALPDTVMWNSFMDSLCKHRRTKDARDIFDSMAAKGQKPDIFSYSTMLNGYAKEGCFDDMTCLFNSMLQNGILPDHRVFNID

SEQ ID NO: 888 - protein, 359 aa, Triticum aestivum; identical to SEQ ID NO: 887

SEQ ID NO: 889 - protein, 359 aa, Triticum aestivum; identical to SEQ ID NO: 887

SEQ ID NO: 890 - protein, 359 aa, Triticum aestivum; identical to SEQ ID NO: 887

SEQ ID NO: 891 - protein, 359 aa, Triticum aestivum; identical to SEQ ID NO: 887

SEQ ID NO: 892 - protein, 359 aa, Triticum aestivum; identical to SEQ ID NO: 887

SEQ ID NO: 893 - protein, 447 aa, Triticum aestivum
MLRQPVTVSVRALNGLFAALARAPPSTICTDALALAIDLFNRMAQAGRRQVPAPTIITYNILIGCCHRACRPDLGPAFFGRLLKAGIKTDVITYSSLFKCLCDMKRTEEALNMLFHKMPEDLPNVISYSVILKSFCDNGRSQLALDLLQMMAKKGADHSPDVMSYNMVIDGFFKEGEVSKACDLFQEMIRQGIVPTEVTYSSIINALCKARAMDKAEVVLRSMVHNGAQPDAVTYNSLIQGYSTLGQLKEVARLLKVTRSQGVMPSVVTYNSLMDYLCKHGRIKEAEEIFYSMAVNGRRPDIVSYSIMLHGYAIEGSLVKMIDLCELMARDGVVPDLRCFNILINAYAKYGRMDVAMLFFEDMLKQGVKPNEFTYLTVISAFCKMGRMDDAMEKFSEMIDIGVPLDTEVYMCMVEGYFNHGDSMKAEEFITRMKNRDINHKPWEGNR

SEQ ID NO: 894 - protein, 241 aa, Triticum aestivum
MDRLCKNGRVTEAQDLFDLMVHMGVKPDVCTYNTLMGGYLFVGKMDEVSKLLDNMVSIGMEPDVITYSILIDGYSKNGRIDDALVVFREMLDTKGKPSVISFNIMIGALLKCGRKEEAKDLFDGIWANGLVPDVITYSLMIQKLIEEGSLQESDDLFLSTEKNGCAADSRRLNAIVRSLLQKGEIPRAGTYLSKIDERGFTLEASTASLLTALASGGKGQEYKELLPEKYHSFLEQGTLNF

SEQ ID NO: 895 - protein, 241 aa, Triticum aestivum; identical to SEQ ID NO: 894

SEQ ID NO: 896 - protein, 454 aa, Triticum aestivum
MEQAHPPNSALVISYPRLRRSGLVGGERWRRIITYNIQMDYLCKSGQCAEARKIFDSMISLGQNPTATTYSILLHGYAMEKSFHDMHCLIDLMVENGISPDHYVYNILISAYAKEEMVGEVMHIFTKMRQQGLNPDAVSYGTVIDLLSRIGRMDDAMSLFNQMITEGLAPGTIVFNHLISGFCTCGKWEKVHELFSEMLDRGICPDTVFFNTVMDRLCKNGRVTEAQDLFDLMVHMGVKPDVCTYNTLMGGYLFVGKMDEVSKLLDNMVSIGMEPDVITYSILIDGYSKNGRIDDALVVFREMLDTKGKPSVISFNIMIGALLKCGRKEEAKDLFDGIWANGLVPDVITYSLMIQKLIEEGSLQESDDLFLSTEKNGCAADSRRLNAIVRSLLQKGEIPRAGTYLSKIDERGFTLEASTASLLTALASGGKGQEYKELLPEKYHSFLEQGTLNF

SEQ ID NO: 897 - protein, 241 aa, Triticum aestivum; identical to SEQ ID NO: 894

SEQ ID NO: 898 - protein, 457 aa, Triticum aestivum
MSNIGMPIFGSKPIMLHVPHAPPQLLHHAHVPHRPPPPPPLLLLLLLLLHLHLATLTVTVMVSPRRLCRGHGARPRRDAQPGGRTPPVRPIATAGHSGPRALPGRLPCRPRPCARLSCLQRWPRPRHRPLQPRMPRRSRPAGGAAHSLHLRHPDELLLPRASSGPRACLIWPPPKDRPQNKLDRRQHRPQVPCCAKRTDEAVNVLIHRMSDLGCVPNEFSYNTVLKSLCEDSRSQRALDLLRVMAKGDGCSPCVVSYSTVIYGFFKEGKVGKACNLFHEMTQQGVVSDVVTYNSIIDALCKARAMDKAELFLRQMVDDDIRPNGVTYTAMIHGYSTLGQWKKATQMFREMTSRGLVPDTVTWNSFMASLCKHGRSREAAELLYSMAAKGHKPNVVSYSTLLHGYANEGCFADMVNLFNSMVGKGIVPDHHVFNIFINAYAKCGMMDEVMHMLTEMQE

SEQ ID NO: 899 - protein, 430 aa, Triticum aestivum
MSRNGVQPDIVTYNIQMDYLCKNGGCAEARKFFDSMISLGQKPTVTTYNILLHGYAMERSFHDMNCLIDLMVGNGIAPDHNVYNILISAYAKEETVGEVMHIFTKMRQQGLNPNAASYGTVINLLCRIGRMDDAVLQFTQMITEGLTPDIIVFTPLISGFCACGKLEKVHELFSEMLDRGIYPDTMFFTTVMDRLCKNGRVMEARDIFDLMVHMGVKPDVRSYATLMHGYFLVGKMDEVRKLLDNMCSIGMEPDVVTYSILIDGYSKNGRIDDAFVVFKEMLEGKVKPCVITFTIMIGALLKCGRKEEAKDLFDGIWANGLVPNVITYSLMIQNLIEEGSLQESDDLFLSMEKNGCAADSRMLNAIVRRLLQRGEMPRAGTYLSKIDEGSFTLEASTAGLLTALASGGKCQEYKGLLPEKYHSFLEQGTD

SEQ ID NO: 900 - protein, 430 aa, Triticum aestivum; identical to SEQ ID NO: 899

SEQ ID NO: 901 - protein, 430 aa, Triticum aestivum; identical to SEQ ID NO: 899

SEQ ID NO: 902 - protein, 442 aa, Triticum aestivum
MSGHFVPVDRRILEQNIKARYHAGDIGTEDALHLFDELLQCAGSSSIRAINYLVTTVGRDSPALGVSLFNRVASANVAPNSMTYTILVDCCCRAGRLDLGFAAMGHIIKMGFAADAIVTFSHLLKAICAEKKTSYAMDIVLRIMPMFNCVPDNFSYNILFKGLCNERRSQEALELIHMMVQHGGSCQPNVVSYNTVVDGLLKEGEVGKAYTLFSEMLRQGISPDVVTCTSIISGMCKVHAMDKAEEVLQQMLDRRILPDAATYNCLIHGYYLLGQCEEVDRIFKEMSRNGVQPNIVTYNIQMDYLCKSGRCAEARKIFDSMIGLGQKPVVTTYSILLHGYAMEKSFHDMHCLIDLMVENGIAPNHPVYNILISACAQEEMVSEVMHIFTKMRQQGLNPNVANYGVVVNLLSRIGRMDDAMSLFNQMITEGLAPDIIVFTPPY

SEQ ID NO: 903 - protein, 442 aa, Triticum aestivum; identical to SEQ ID NO: 902

SEQ ID NO: 904 - protein, 442 aa, Triticum aestivum; identical to SEQ ID NO: 902

SEQ ID NO: 905 - protein, 442 aa, Triticum aestivum; identical to SEQ ID NO: 902

SEQ ID NO: 906 - protein, 442 aa, Triticum aestivum; identical to SEQ ID NO: 902

SEQ ID NO: 907 - protein, 442 aa, Triticum aestivum; identical to SEQ ID NO: 902

SEQ ID NO: 908 - protein, 435 aa, Triticum aestivum
MSRLRLLRRSSSSTTLIPLLRLLRRCSTSTSTSPPSRSWSPRDAFVAAIERVRARTLSPEDAHHLFDDLLGQATPVPVRTLNGFFAVLARATSSAACIRDGPALAVALFNRVCQEEAGPRVATPTVHTYGILMDCCCRARRPDLGLALFGRFLGTGLRTNEIVATTFLKCLCCAKRTEEVVKVLLHRMPELGCVPNAISYSIVLKSLCENSMSQQALDLLQMVGKEGGCLRDVVAYNTIIHGFFKECGIDKACHLFHEMMRQGVVPTVVTYNTVIDALCKAGEMDKAELVFQRMARNGAQPNKVTCNGSKFSSLTDGYCSVGKMDKTFKLLDAMVSDGIEPDAVTYSALLDGYFKNGRIDDGLTLFREMSCKGVKPTTVTYGIILDGLYRAGRTAAAKKMFDQMIKSGITVTVSIYTTPSFPVYKAYFNFFVFPI

SEQ ID NO: 909 - protein, 435 aa, Triticum aestivum
MSRLRLLRRSSSSTTLIPLLRLLRRCSTSTSTSPPSRSWSPRDAFVAAIERVRARTLSPEDAHHLFDDLLGQATPVPVRTLNGFFAVLARATSSAACIRDGPALAVALFNRVCQEEAGPRVATPTVHTYGILMDCCCRARRPDLGLALFGRFLGTGLRTNEIVATTFLKCLCCAKRTEEVVKVLLHRMPELGCVPNAISYSIVLKSLCENSMSQQALDLLQMVGKEGGCLRDVVAYNTIIHGFFKECGIDKACHLFHEMMRQGVVPTVVTYNTVIDVLCKAGEMDKAELVFQRMARNGAQPNKVTCNGSKFSSLTDGYCSVGKMDKTFKLLDAMVSAGIEPDAVTYSALLDGYFKNGRIDDGLTLFREMPCKGVKPTTVTYGIILDGLYRAGRTAAAKKMFDQMIKSGITVTVSIYTTPSFPVYKAYFNFFVFPI

SEQ ID NO: 910 - protein, 436 aa, Triticum aestivum
MVDLYNSMSSNGIVPNRQVFNILIDAYAKRGMTDEAMLIFTEMRGQGLSPDVCTYSTLISALSRTGRLADAMDRFSQMISIGIQPDAVVYQALIQGYCTVGDLVKAKVLVSEMMNRGIPPPDIVFFNSIMTSLCKEGRVTDAHSILDFVIHFGVRPSISTFNLLIDGYCLVGKMKKAFGVLDTMASVGIEPDDISYSAIINGCFKNGRIDDGFTIFREMLKKVKPTTVTYNIILGGLFCAGKTVAAMKMFHEMIESGITVSSSTYRTVLGGLCRNSCEDEAITLFQKLGAMNVKLDIAILNTMINAMFKLQRREEANDLFSAVSASGLVPNASTYGVMIKNLLREGSVEKAENMFSLMEKSGCAPDSRLINDIIRILLKKGEIVKAGNYMSKVDGRSISLEASTTSLMIRLFSSEGKYRGQINLLPVKYQFFDGVS

SEQ ID NO: 911 - protein, 365 aa, Triticum aestivum
MDRFSQMISIGIQPDAVVYQALIQGYCTVGDLVKAKVLVSEMMNRGIPPPDIVFFNSIMTSLCKEGRVTDTHSILDFVIHFGVRPSISTFNLLIDGYCLVGKMKKAFGVLDTMASVGIEPDDISYSAIINGCFKNGRIDDGFTIFREMLKKVKPTTVTYNIILGGLFCAGKTVAAMKMFHEMIESGITVSSSTYRTVLGGLCRNSCEDEAITLFQKLGAMNVKLDIAILNTMINAMFKLQRREEANDLFSAVSASGLVPNASTYGVMIKNLLREGSVEKAENMFSLMEKSGCAPDSRLINDIIRILLKKGEIVKAGNYMSKVDGRSISLEASTTSLMIRLFSSEGKYRGQINLLPVKYQFFDGVS

SEQ ID NO: 912 - protein, 365 aa, Triticum aestivum; identical to SEQ ID NO: 911

SEQ ID NO: 913 - protein, 365 aa, Triticum aestivum; identical to SEQ ID NO: 911

SEQ ID NO: 914 - protein, 365 aa, Triticum aestivum; identical to SEQ ID NO: 911

SEQ ID NO: 915 - protein, 436 aa, Triticum aestivum; identical to SEQ ID NO: 910

SEQ ID NO: 916 - protein, 444 aa, Triticum aestivum
MARALPSPSSTACPEALVHGWCRCRAGRPDLVVAFFGRLLRLGLCLNVISLSNLLKGLCQVKRTNEAVDLLLHRTPELDCVPNVFSYSIVINGCFKQGEVDKACNLFHGMIQLGVQPNVVIYTSIIDALSKCGAMDKAEVVFRQMVDKGIGPDVMTCTSLIHGYSISGRWKAAVRVFKEMISLGVVPDTVMWNSFVDSLCKHRRTKEARVIFDSMAAKGQKPDTVSYSIMLNGYVKEGCFDDMTGLFNSMLQNGVVPNHHIFNILINAYAKRGLMDEAMHMFEVMRQQGVNPDVVDYLVVMDSLCKMGRMDAALDKFNQMVNQGVSPNKAVYQCLVLGSCSHGDFVKAKELISEALNRGLCSNSVFFYPVINDLCKEGKVKEAQDMFDFIVGIGQRPDVIMYNSLMDGYCLVGKVEEALRVLDAMKSAGLQPDAIMYGILLNDH

SEQ ID NO: 917 - protein, 444 aa, Triticum aestivum; identical to SEQ ID NO: 916

SEQ ID NO: 918 - protein, 444 aa, Triticum aestivum; identical to SEQ ID NO: 916

SEQ ID NO: 919 - protein, 439 aa, Triticum aestivum
MMSLFNSMEGDGIVANSYVFNILINAYAKGGMMDEAMLILTEMRGQGLSPDVFTYSTLVSAFCRMGRLADAMDKFSQMIGTGVQPNTVVYHSLVQGLCTHGDLVKAKELISEMMNKGMIRPNIAFFNSIMDSLCNEGRVVDAHHIFDLVTDIGEKPDVITFSTLIDGYCLVGEMEKACRVFDAMVSAGIEPDVITYSTLVSGYCKSGRIDDGLILFREMLHKEVKPTTVTYGTVLDGLFRAWRSAAAKKVFHEMIESGIMVSISIYNIILGGLCRNNCADEAIVLFQKLCAMNVKFNITTLNIMLNAFYKVQRRDEASDLFAALPASGLVPNASTYGVMIQNLLKEGAVEEADSMFSSMEKSGCAPSSRFSNCIIRTLLEQGEIVKAGKYMSKVDGKTFLLEASTTSLLMSLFSRGGKYQEHILLLPAKYQFFSGVNHS

SEQ ID NO: 920 - protein, 439 aa, Triticum aestivum
MMSLFNSMEGDGIVANSYVFNILINAYAKGGMMDEAMLILTEMQGQGLSPDVFTYSTLVSAFCRMGRLADAMDKFSQMIGTGVQPNTVVYHSLVQGLCTHGDLVKAKELISEMMNKGMIRPNIAFFNSIMDSLCNEGRVVDAHHIFDLVTDIGEKPDVITFSTLIDGYCLVGEMEKACGVFDAVVSAGIEPDVITYSTLVSGYCKSGRIDDGLILFREMLHKEVKPTTVTYGTVLDGLFRAWRSAAAKKVFHEMIESGIMVSISIYNIILGGLCRNNCADEAIVLFQKLCAMNVKFNITTLNIMLNAFYKVQRRDEASDLLAALPASGLVPNASTYGVMIQNLLKEGAVEEADSMFSSMEKSGCAPSSRFSNCIIRTLLEQGEIVKAGKYMSKVDGKTILLEASTTSLLMSLFSRGGKYQEHILLLPAKYQFFSGVNHS

SEQ ID NO: 921 - protein, 439 aa, Triticum aestivum; identical to SEQ ID NO: 919

SEQ ID NO: 922 - protein, 439 aa, Triticum aestivum; identical to SEQ ID NO: 920

SEQ ID NO: 923 - protein, 384 aa, Triticum aestivum
  misc_feature (354)..(354): Xaa can be any naturally occurring amino acid
  misc_feature (371)..(371): Xaa can be any naturally occurring amino acid
  misc_feature (373)..(373): Xaa can be any naturally occurring amino acid
MMSLFNSMEGDGIVANSYVFNILINAYAKGGMMDEAMLILTEMRGQGLSPDVFTYSTLVSAFCRMGRLADAMDKFSQMIGTGVQPNTVVYHSLVQGLCTHGDLVKAKELISEMMNKGMIRPNIAFFNSIMDSLCNEGRVVDAHHIFDLVTDIGEKPDVITFSTLIDGYCLVGEMEKACRVFDAMVSAGIEPDVITYSTLVSGYCKSGRIDDGLILFREMLHKEVKPTTVTYGTVLDGLFRAWRSAAAKKVFHEMIESGIMVSISIYNIILGGLCRNNCADEAIVLFQKLCAMNVKFNITTLNIMLNAFYKVQRRDEASDLFAALPASGLVPNASTYGVMIQNLLKEGAVEEADXMFSSMEKSGCAPSSRLXNXVSSELYWKRGR

SEQ ID NO: 924 - protein, 439 aa, Triticum aestivum; identical to SEQ ID NO: 919

SEQ ID NO: 925 - protein, 439 aa, Triticum aestivum; identical to SEQ ID NO: 920

SEQ ID NO: 926 - protein, 360 aa, Triticum aestivum
MDCCCRADRPDLVVAFFGRLLRLGLRLNVISFNNLLKGLCQAKRSNEALDLLLHRMPELDCAPDVFSFNIVINGCFREGEVDKACNLFHEMPQLGVQPDVVTYNSIIIALSRAGAMGKAEVVLRQMVDKGIGPDVMTYNSLIHGYSTLGQWKAAVRVFKEMVSVGVLPNAVTLNSFMDSLCKHRRTKEARDIFDSMAAKGHKPNIASYSTMLNGYAKQGCFDDMTGLFNSMVQNGVVPNHHIFNILINAYAKRGLMDEAMHMFEVMRQQGVNPDVFSHQIVMDSLCKMGRMDAALDKFNQMVNQGVSPNKAVYQCLVLGSCSHGHFVKAKELISEAVNRGLCSNSVFFYPVVNDLCKEGR

SEQ ID NO: 927 - protein, 430 aa, Triticum aestivum
MSRNGVQPDIVTYSIQMDYLCKSGRCTEARKIFDSMISLGQKPTVTTYNILLHGYAMERSFYDMNCLIELMDDNGISPDHYGYNILISAYAKEETVGEVMHIFTKMRQQGLNPNVVNYGAVINLLSSIGRMDDAMSQFNQMITEGLAPDIIVFTPLISGFCSCGKWEKVHELFSEMLDRGIYPNTVFFTTVMDRLCKNGRAMEARDIFDLMVHMGVKPDVRSYATLMHGYFLVGKMDEVRKLLDNMCSIGMEPDVVTYSILIDGYSKNGRIDDAFVVFKELLEGKVKPCVITFNIMIGALLKCGGKAEAKDLFDGIWANGLVPDVITYSLMIQKLIEEGSLQESDDLFLSMEKNGCAADSRMLNAIVRRLLQRGEMPRAGTYLSKIDEGSFTLEASTAGLLTALASGGKCQEYKGLLPEKYHSFLEQGTG

SEQ ID NO: 928 - protein, 221 aa, Triticum aestivum
MLRKGLKPTTFNYNVILDGLFLAGRTVAAKEKFDEMVESGVSVCIDTYSIVLGGLCRNNCSGEAITLFQKLSTMDVKFNIIIVNIMIDAFYRVQRNQEAKDLFAAVSANGLVANVFTYTIMMKNLIKEGSVEEADDLFLSMEKSGCTADSYMLNLIVRMLLEKGELVKAGNYMSKVDAKSYSLEAETVSLLISLFSGKGKYREHIGLLPTKYRFREEAATV

SEQ ID NO: 929 - protein, 432 aa, Triticum aestivum
MAIKGLKPDNVSYAIRLHGYATEGCFVDMINLFNSMERDCILPDCRIFSILIYAYAKSGKLDKAMLIFNEMQKQGVSPNAVTYSTVIDAFCKKGRLDDAVIKFNQMIDTGVRPDTAVYSSLIQGFCTRGDLVKAKELLTKMMNKGIPPSDIKFFSSIMQNLCTEGRVTEARDVLGLIAHIGMRPNVCTFNILIGGYCLVGKMEDASKIFDDMMSYGLEPSNITYGILINGYCKNLRIDDGLILFKEMLRKGLKPTTFNYNVILDGLFLAGRTVSAKEKFDEMVESGVSVCIDTYSIVLGGLCRNNCSGEAITLFQKLSTMDVKFNITIVNIMIDAFYRVQRNQEAKDLFAAVSANGLVANVFTYTIMMKNLIKEGSVEEADDLFLSMEKSGCTADSYMLNLIVRMLLEKGELVKAGNYMSKVDAKSYSLEAT

SEQ ID NO: 930 - protein, 432 aa, Triticum aestivum; identical to SEQ ID NO: 929

SEQ ID NO: 931 - protein, 221 aa, Triticum aestivum
MLHKGLKPTTFNYNVILDGLFLAGRTVAAKEKFDEMVESGVSVCIDTYSIVLGGLCRNNCSGEAITLFQKLSTMDVKFNIIIVNIMIDAFYRVQRNQEAKDLFAAVSANGLVANVFTYTIMMKNLIKEGSVEEADDPFLSMEKSGCTADSYMLNLIVRMLLEKGELVKAGNYMSKVDAKSYSLEAETVSLLISLFSGKGKYREHIGLLPTKYRFREEAATV

SEQ ID NO: 932 - protein, 221 aa, Triticum aestivum; identical to SEQ ID NO: 928

SEQ ID NO: 933 - protein, 432 aa, Triticum aestivum; identical to SEQ ID NO: 929

SEQ ID NO: 934 - protein, 432 aa, Triticum aestivum; identical to SEQ ID NO: 929

SEQ ID NO: 935 - protein, 221 aa, Triticum aestivum; identical to SEQ ID NO: 928

SEQ ID NO: 936 - protein, 221 aa, Triticum aestivum; identical to SEQ ID NO: 928

SEQ ID NO: 937 - protein, 221 aa, Triticum aestivum; identical to SEQ ID NO: 928

SEQ ID NO: 938 - protein, 439 aa, Triticum aestivum
MPTARLSSISTSSFRAPSRKPRAPLAALAAATERVRAGTLSREDAHHLFDELQGQAAAVPERGLNNFLAALARAPPSSACSDGPGLAFALFNRMSRGAGARVVSPTLCTYSILMDCCCRAGRPDLVVAFFGRLLRLGLRLNVISFNNLLKGLCQAKRSNEALDMLLHRMPEQDCAPDVFSFNIVINGCFREGEVDKACNLFHEMPQLGVQPDVVTYNSIIIALSRAGAMGKAEVVLRQMVDKGIGPDVMTYNSLIHGYSTLGQWKAAVRVFKEMVSVGVLPNAVTLNSFMDSLCKHRRTKEARDIFDSMAAKGHKPNIASYSTMLNGYAKQGCFDDMTGLFNSMLQNGVVPNHHIFNILINAYAKRGLMDEAMHMFEVMRQQGVNPDVFSYQIVMDSLCKWVGWMLLWTNLIRWSIKEFHLTKLFTNAWFWVLVLMVIL

SEQ ID NO: 939 - protein, 431 aa, Triticum aestivum
  misc_feature (390)..(390): Xaa can be any naturally occurring amino acid
MPTARLSSISTSSFRAPSRKPRAPLAALAAATERVRAGTLSREDAHHLFDELQGQAAAVPERGLNNFLAALARAPPSSACSDGPGLAFALFNRMSRGAGARVVSPTLCTYSILMDCCCRAGRPDLVVAFFGRLLRLGLRLNVISFNNLLKGLCQAKRSNEALDMLLHRMPELDCAPDVFSFNIVINGCFREGEVDKACNLFHEMPQLGVQPDVVTYNSIIIALSRAGAMGKAEVVLRQMVDKGIGPDVMTYNSLIHGYSTLGQWKAAVRVFKEMVSVGVLPNAVTLNSFMDSLCKHRRTKEARDIFDSMAAKGHKPNIASYSTMLNGYAKQGCFDDMTGLFNSMLQNGVVPNHHIFNILINAYAKRGLMDEAMHMFEVMKQQGVNPDVVXYLVVMDSLCKMGKMAAAMDKFNQMINQGVSPNKAVYQCLGK

SEQ ID NO: 940 - protein, 412 aa, Triticum aestivum
MSRRMVRRVLERNIEERYRAGHIGTEDALHLFDELLQVAGPSSTRAINCLLYVVGRDCPALGVSLFNRVARAKVPPHNVTYSILIGCCCHAGRLDLGFAAMGNIIKLGFAAEAMFSFSHLLRAVCAENKTSYAMDIALRRMPEFNCTPNVFSYSILLKGLCVEKRSQEALELIHMMVDAGGSCQPNVVSYSTVVDGLLKEGEVNKAYSLLCEMLHQGISPNVVTYSSIIFSMCKVQAMDKAEEVLQQMFDTGILPNITTYNSLIHGYYSSGQCEEVVRIFKKMSRNGVQPDIATYNIQMDYLCKSRRFAEARTIFDSMAGKDQKPNVTSCSILLHAYAMEQSFHDMHCLIELMVENGIAPDHSVYNILIVVYAKGKMVDEVMHIFTKMRQQGLNPNAANYGTVINLQYWPNG

SEQ ID NO: 941 - protein, 412 aa, Triticum aestivum; identical to SEQ ID NO: 940

SEQ ID NO: 942 - protein, 412 aa, Triticum aestivum; identical to SEQ ID NO: 940

SEQ ID NO: 943 - protein, 412 aa, Triticum aestivum; identical to SEQ ID NO: 940

SEQ ID NO: 944 - protein, 412 aa, Triticum aestivum; identical to SEQ ID NO: 940

SEQ ID NO: 945 - protein, 412 aa, Triticum aestivum; identical to SEQ ID NO: 940

SEQ ID NO: 946 - protein, 425 aa, Triticum aestivum
MSNLRLLRRSSSSMSTTTSPPSRSWSPHSAFAAATERVRAGTLSQDDAHHLFDELLRQATPVHERSLNGFLAALARATSSAACIRDGPALAIALFNRVCREQAGPRVAPLTVHTYGILMECCCRAGHPELGLAIFSRLLRTGLKTNEIVGSTFLKCLSYTKRTDEALNVLLHRMPELGCVPNAFSYSIVLKSLCDNSMSQRALDLLQRMAKEGGGCFLNVVTYSTVIHGFFKEGEIGKACSLFHEMMQQGIEPDVWTYNSIIDALCKARAMDKAELVLRQMVAKGAQPDTVTYNCMINGYATSGRLKEAAKMFREMKSRGVTPNIVTCGSLMTSLCKHGRSKEARQIFDSMTAKGHRANVVSYSILLHGYANEGCFADMIDLFNSMKSNGIAADCHVFNILINGYAKRGMMDEAVLILLKCGKKE

SEQ ID NO: 947 - protein, 425 aa, Triticum aestivum; identical to SEQ ID NO: 946

SEQ ID NO: 948 - protein, 425 aa, Triticum aestivum; identical to SEQ ID NO: 946

SEQ ID NO: 949 - protein, 425 aa, Triticum aestivum; identical to SEQ ID NO: 946

SEQ ID NO: 950 - protein, 425 aa, Triticum aestivum; identical to SEQ ID NO: 946

SEQ ID NO: 951 - protein, 425 aa, Triticum aestivum; identical to SEQ ID NO: 946

SEQ ID NO: 952 - protein, 429 aa, Triticum aestivum
MEHASKIFDDMMSHGLEPSNITYGILINGYCKNRRIDDGLILFKEMLHKGLKPTTFNYSLDIAMDKFNQMVDMGVRPNAIVYHSLIQGFCTHGDLVKAKELVAEMRNKAMRPPDIKFFHSIMQNLCTEGRVIEARDILDLIVRIGMRPDVPIFNLLIGGYCLVRKMADASKIFDDMVSYGLEPSNITYGILINGYCKNRRIDEGLILFKEMLCKGLKPTTFNYNVILDGLFLAGRTVAAKEKFDEMVESGVSVCIGTYSIVLGGLCRNNCSGEAITLFQKLSTMDVKFNIIIVIDAFYKVQRNQEAKDLFAAVSANGLVANVFTYTIMMKNLIKEGSVEEADDLFLSMEKSSCTADSYMLNLIVRMLLGKGEIVKAGNYISKIDAKSYSLEAKTVSLLISLFSGKGKYREHIGLLPAKYRFREEAATVV

SEQ ID NO: 953 - protein, 363 aa, Triticum aestivum
MSRLRPRRSSTTPMFHLLRRSSSSTSTSTPTLRPSRSWSPHAAFAAATERVRAGTLSPEDAHHLFDELLRQATPVPSRSLDGFIAALARAPASAACIRDGPALALGLFNRVCRDEAGARVAPRTIFTYGILMNCCCCAHRPDLGLALFGRFLRTGMKANEIIATTFLKCLCSAKRTDEAVNLLLHRIPELGCVRNAFSYSIVLKSFCENSMSQRGLDLLQMMAKEGGACSPNVVAYSTVIHGFFKEGETGKACNLFHEMMQQGVVPTVATYNSIIDALCKARAMDKAEIVLRQMVDNGAQPDNWTYNCMIHGYSTSGQLREATKMLRKMTTRGLIPDIVTCSSLMASLCKHGRSKEASDFFVP

SEQ ID NO: 954 - protein, 363 aa, Triticum aestivum
MSRLRPRRSSTTPMFHLLRRSSSSTSTSTPTLRPSRSWSPHAAFAAATERVRARTLSPEDAHHLFDELLRQATPVPSRSLDGFIAALARAPASAACIRDGPALALGLFNRVCRDEAGARVAPPTIFTYGILMNCCCCAHRPDLGLALFGRFLRTGMKANEIIATTFLKCLCSAKRTDEAVNLLLHRIPELGCVRNAFSYSIVLKSFCENSMSQRGLDLLQMMAKEGGACSPNVVAYSTVIHGFFKEGETGKACNLFHEMMQQGVVPTVATYNSIIDALCKARAMDKAEIVLRQMVDNGAQPDNWTYNCMIHGYSTSGQLREATKMLRKMTTRGLIPDIVTCSSLMASLCKHGRSKEASDFFVP

SEQ ID NO: 955 - protein, 363 aa, Triticum aestivum; identical to SEQ ID NO: 953

SEQ ID NO: 956 - protein, 363 aa, Triticum aestivum; identical to SEQ ID NO: 953

SEQ ID NO: 957 - protein, 363 aa, Triticum aestivum; identical to SEQ ID NO: 953

SEQ ID NO: 958 - protein, 363 aa, Triticum aestivum; identical to SEQ ID NO: 954

SEQ ID NO: 959 - protein, 433 aa, Triticum aestivum
MSRLQVRSFSSPVSSRANDLLTELHGHLGFGTLRPELAHQLFDEMLRQPVPVSARALNGLFAALACAPPSAACTDGPVLAIHLFNRMARAGCRRVIALTSHTYSILIECCCRARRPDLGPSFFTHLLKTGVTADIVIYSGLFKCLCDLKCTEEALDMLLHRMPNDVSDAISYSVILKSLCDNGRSQLALDVLHIMTKKGADYSPDVFAYNMVIDGFFKEGEVSKACDLFHEMIQQGVVPDVAMYTSIINALCKARAMDKAEVVLQSMVHNGVQPDVVTYTILIQGYSTLRQLKEVARLLKVMRSQGVMPSVVTYNSLMTCLCKNGRFKEAVEIFYSMAVKGLKPNVISYSIILHGYAKEGSLVAMIDLYQLMAAEGVIPDLHCFNILIAAYAEYGMMDVAMLFFEDMLKQGVNPNEVTNFVCDSWIMQNGQDG

SEQ ID NO: 960 - protein, 433 aa, Triticum aestivum
MSRLQVRSFSSPVSSRANDLLTELHGHLGFGTLRPELAHQLFDEMLRQPVPVSARALNGLFAALACAPPSAACTDGPVLAIHLFNRMARAGCRRVIPLTSHTYSILIECCCRARRPDLGPSFFTHLLKTGVTADIVIYSGLFKCLCDLKCTEEALDMLLHRMPNDVSDAISYSVILKSLCDNGRSQLALDVLHIMTKKGADYSPDVFAYNMVIDGFFKEGEVSKACDLFHEMIQQGVVPDVAMYTSIINALCKARAMDKAEVVLRSMVHNGVQPDVVTYTILIQGYSTLRQLKEVARLLKVMRSQGVMPSVVTYNSLMTCLCKNGRFKEAVEIFYSMAVKGLKPNVISYSIILHGYAKEGSLVAMIDLYQLMAAEGVILDLHCFNILIAAYAEYGMMDVAMLFFEDMLKQGVNPNEVTNFVCDSWIMQNGQDG

SEQ ID NO: 961 - protein, 433 aa, Triticum aestivum; identical to SEQ ID NO: 959

SEQ ID NO: 962 - protein, 433 aa, Triticum aestivum; identical to SEQ ID NO: 959

SEQ ID NO: 963 - protein, 433 aa, Triticum aestivum; identical to SEQ ID NO: 959

SEQ ID NO: 964 - protein, 433 aa, Triticum aestivum; identical to SEQ ID NO: 959

SEQ ID NO: 965 - protein, 401 aa, Triticum aestivum
MARAGRRQATTPTIYTYNILMECCHRACCPDLGLAFFGRLLKTGIPTNIIDYSSLFKCLCDMKRTEEALNVLLHKMPDDLPNVISYSVILKSFCDNGRSQLALDLLQMMAKKGADHSPDVMSYNMVIGGFFKEGEVSKACDLFQEMIRHGIVPTEVTYSSIINALCKARAMDKAEVVLRSMVHNGAQPDAVTYNSLIQGYSTLGQLKEVARLLKVMRSQGVMPSVVTYNSLMTCLCKHGKTKEAEKIFYSMAVNGRKPDVISYSILLHGYAKEGSLIDMIDLCERMPRDGVVPNLHCFNILINAYAKHGMMDVALLFFEDMLKQVVKPNEFTYLTVISAFCKMGRMDDAMEKFREMIDMGVPVDTEVYMCIVEGYFKNGDSVKAKDFITKMIPNRPQKGNY

SEQ ID NO: 966 - protein, 428 aa, Triticum aestivum
MFSPTLFFSSLCNEKRSQEALELIHIMVDHGGSCQPNVVSYNTVVDGLLKEGEAGKAYSLFSEMLRQGISPDVVTCSSIIAGICKVHAMDKAEQVLQQMLDRGILPNVATYTSLIHGYYSLGQCEEVDRVLKEMSRNGVQPNIVTYNIQIDYLCKSGRCAEARKIFDSMISLGQKPTVTTYSILLHGYAIEKSFHHMHCLIDLMVENSIAPDHFVYNILISAYAKEEMVSEVLHIFTKMRQQGLNPNVASYGVIINLLSSIGRMDDAMSKFNQMITEGLAPNIIVFSTVISGFYSCGAWERVHEIFSEMLNRGIYPATVFFNIIMDHLCKEGRVMEAQDIFDLMVHMGVKPVVHNYKTLIHGYWSVSKMDEVSKLLDNVVLIGMEPDVVTYNTLIDGYSKNGRIDDALVVFREMMAGRLSLLLSLLLL

SEQ ID NO: 967 - protein, 413 aa, Triticum aestivum
MSRLRHSSATPISSLRLLRHISSSTSTPTPTSPTSCSWSPHAAFGAATERVRAGTLRPEDAHTLFDELLRQATPVPERSLNGFLAALARAPASGNCIRDGPALAVALFSRVCREEAGPQVAALTVCTYNILMDCCCRARRPELGLALFGRFLRKGLKTDQTGASTFLKCLCYAKRTDEAVDVLLHRMSELGCVPDAISYNTVLKSLCDNGMSQRGLELLQLVAGKGGGCFPDVVAYSTVIHGFFQEGEAGKACSLFHEMMQQGIVPSVVTYSSIIDALCKARAMDRAELVLRQMVANGAQPDTVTYNCMINGYATSGRLKESAKMFREMKSRGLMPDIVTCNSFLSSLCKHGRSKEAAEFFDSMTAKGHKPDIVSYRILLHGYATEGCFADMIDLFNAMERNGIAADCVFSTY

SEQ ID NO: 968 - protein, 413 aa, Triticum aestivum
MSRLRHSSATPISSLRLLRHISSSTSTPTPTSPTSCSWSPHAAFGAATERVRAGTLRPEDAHTLFDELLRQATPVPERSLNGFLAALARAPASGNCIRDGPALAVALFSRVCREEAGPQVVALTVCTYNILMDCCCRARRPELGLALFGRFLRKGLKTDQTGASTFLKCLCYAKRTDEAVDVLLHRMSELGCVPDAISYNTVLKSLCDNGMSQRGLELLQLVAGKGGGCFPDVVAYSTVIHGFFQEGEAGKACSLFHEMMQQGIVPSVVTYSSIIDALCKARAMDRAELVLRQMVANGAQPDTVTYNCMINGYATSGRLKESAKMFREMKSRGLMPDIVTCNSFLSSLCKHGRSKEAAEFFDSMTAKGHKPDIVSYRILLHGYATEGCFADMIDLFNAMERNGIAADCVFSTY

SEQ ID NO: 969 - protein, 413 aa, Triticum aestivum; identical to SEQ ID NO: 968

SEQ ID NO: 970 - protein, 413 aa, Triticum aestivum; identical to SEQ ID NO: 968

SEQ ID NO: 971 - protein, 413 aa, Triticum aestivum; identical to SEQ ID NO: 968

SEQ ID NO: 972 - protein, 413 aa, Triticum aestivum; identical to SEQ ID NO: 968

SEQ ID NO: 973 - protein, 391 aa, Triticum aestivum
MGHVIKLGFAAQAVVNFSHLLKAICAEKKTSYAMDIVLRVIPMFNCVPDVFSYSILFKGLCNERRSQEALELIHIMVQHGGSCQPNVVSYSTVIDGLLKEGEMNKAYSLFCEMLQWGISPNVVTCNSIISGMCKLHAMDKAEEVLQQMLDRGILPNSTTYNGLIHGYYSLGQCEEVGRIFKEMSRNGVQPNIVTYNIQMDYLCKSGRCAEARKIFDSMVSLGQKPDVTTYGILLHGYAMERSFHDIHCLIDLMVGNGLSPNNYIYSILISACAKEKMVDEAMHIFTKMQQQGFNPDVVSYGMVIDLLSSIGRMDDAMSQFNQMITEGLAPDIIVSTPLLVVSVLVANGRRFMNYFLRCWIAASVPTECSSTLIWITFAKVEGLWKPRISST

SEQ ID NO: 974 - protein, 391 aa, Triticum aestivum; identical to SEQ ID NO: 973

SEQ ID NO: 975 - protein, 406 aa, Triticum aestivum
MTDEAMLIFTEMREKGVGPDAFTYSTVIAALSRMGRLTDAMGKLSQMIAMGVQPDTAVYHSLIQGCCIHGDLVKAKELVSEMMNKGIPRPSIAFFSSVINYLCKEGRVMDAHDIFDLVIDMGERPDVITFNSLIDGYCLVDKMDKALRVLDSMVSFGIEPNVVTYNTLVNGYCTNGRIDDGLTLFREMPHKRIKPDTVTYGIILDGLFRSGSTVAARKMFHEMTESGITVSISTYSIILGGFCRNNCADEAITLFQKLGTMNVKFDIAILNTMINAMYKVGRREEAKDLFAAISPSSLVPNESTYAVMIKILLKDGAVEDADNMFSSMDNSGIVPSSRLINDIIRMLLEKGEIAKAGNYLSKVDGKSISLEASTASLMLSLFSRKGKHQEDIKLLPAKYQFFDGFG

SEQ ID NO: 976 - protein, 406 aa, Triticum aestivum
MTDEAMLIFTEMREKGVGPDAFTYSTVIAALSRMGRLTDAMGKLSQMIAMGVQPDTAVYHSLIQGCCIHGDLVKAKELVSEMMNKGIPRPSIAFFSSVINYLCKEGRVMDAHDIFDLVIDMGERPDVITFNSLIDGYCLVDKMDKALRVLDSMVSFGIEPNVVTYNTLVNGYCTNGRIDDGLTLFREMPHKRIKPDTVTYGIILDGLFRSGSTVAARKMFHEMTESGITVSISTYSIILGGLCRNNCADEAITLFQKLGTMNVKFDIAILNTMINAMYKVGRREEAKDLFAAISPSSLVPNESTYAVMIKILLKDRAVEDADNMFSSMDNSGIVPSSRLINDIIRMLLEKGEIAKAGNYLSKVDGKSISLEASTASLMLSLFSRKGKHQEDIKLLPAKYQFFDGFG

SEQ ID NO: 977 - protein, 406 aa, Triticum aestivum; identical to SEQ ID NO: 975

SEQ ID NO: 978 - protein, 406 aa, Triticum aestivum; identical to SEQ ID NO: 975

SEQ ID NO: 979 - protein, 406 aa, Triticum aestivum; identical to SEQ ID NO: 975

SEQ ID NO: 980 - protein, 406 aa, Triticum aestivum; identical to SEQ ID NO: 975

SEQ ID NO: 981 - protein, 411 aa, Triticum aestivum
MPRFSSTTSMSSLRLRLPLRLHARHSSSASQPSHSQGWDPHAAFAAATERARSGSLTPADAHHLFDELLRQANPVQERPLNNFLAALARAPALTVALFSLISKGARRRVAQPNVFTYGVLMDCCCRAHRPDLALAFFGRFLRTGLEADQVVFNTLLKGLCHAKQADEAVNVLLHRMPDLGCTPNVVAYNTVIHGFFREGQVGKACDMFHGMAHKGVMPNVVTYNSVIDALCKARAMDKAETVLSQMVNDGVGPNNVTYDSLIHGYSSLGNLKEAVRVFKEMSRRFTPDVVTCTSLMAFLCKNGKSKEAAEIFDSMATKGLKRDTVSYAILLHGYATEGCLVDMINLFNSMATDCILPNCHIFNILINAYAKSGKLDKAMLIFNEMQKQGVSPDLTRWLIWEYDRMQLFIIP

SEQ ID NO: 982 - protein, 411 aa, Triticum aestivum
MPRFSSTTSMSSLRLRLPLRLHARHSSSASQPSHSQGWDPHAAFAAATERARSGSLTPADAHHLFDELLRQANPVQERPLNNFLAALARAPALTVALFSLISKGARRRVAQPNVFTYGVLMDCCCRAHRPDLALAFFGRFLRTGLEADQVVFNTLLKGLCHAKQADEAVNVLLHRMPDLGCTPNVVAYNTVIHGFFREGQVGKACDMFHGMAHKGVMPNVVTYNSVIDALCKARAMDKAETVLSQMVNDGVGPNNVTYNSLIHGYSSLGNLKEAVRVFKEMSRRFTPDVVTCTSLMAFLCKNGKSKEAAEIFDSMATKGLKRDTVSYAILLHGYATEGCLVDMINLFNSMATDCILPNCHIFNILINAYAKSGKLDKAMLIFNEMQKQGVSPDLTRWLIWEYDRMQLFIIP

SEQ ID NO: 983 - protein, 409 aa, Triticum aestivum
MPCQHPPWPAPARPTTCELSRLTSAAARAELIPASAAAASPLPPRCPRAAVLLATPPSLHSTTPMSRIRLRRSRLFSSCATTPPPAGSWSPHAAFAAATERALAGKLSGEDAHHLFDELLRQATPVPERSLNGFLTALARAPDSSTFRNGPALARAPDSSTFRNGPALAIALFNRLCREEAGSRVAWPTVCTYNILMDCRCRTRRPDLGPAFLGRLLRTGLKTNQIVANTLLKCLCYAKRTDEAVNVLLHKMSELGCVPDAISYNTVLKRLCEDSRSQGALDLLRTVAKEGGVGSLDVVSHGTVIHGFFKEGETGKACNLFHEMTQQGIVPNVVTYNLIIDALCKARAMDKAELILRQMVDNGVRPDTVTCSSIMSSLCKHGRSKEAAEIFDSMTAKGLKADVFSYSVS

SEQ ID NO: 984 - protein, 409 aa, Triticum aestivum; identical to SEQ ID NO: 983

SEQ ID NO: 985 - protein, 224 aa, Triticum aestivum
MPCQHPPWPAPARPTTCELSRLTSAAARAELIPASAAAASPLSPRRPRAAVLLATPPSLHSTTPMSRIRLRRSRLFSSCATTPPPAGSWSPHAAFAAATERALAGKLSGEDAHHLFDELLRQATPVPERPLNGFLTALARAPDSSTFRNGPALARAPDSSTFRNGPALAIALFNRLCREEAGSRVAWPTVCTYNILMDCCCRTRRPDLGPAFLGRLLRTGLKTN

SEQ ID NO: 986 - protein, 409 aa, Triticum aestivum; identical to SEQ ID NO: 983

SEQ ID NO: 987 - protein, 367 aa, Triticum aestivum
MPVMPRFYSTTPMPRLLRRLSSTSTSTSGPSRCWDPSAALAAATERVRAGTLSPADARHLFDELLQRPTPVPGQALNGFLAALARAPASAACGDSPALAVSLFNRLCREASPHASPLTVHTYSILMDCCCRARRPDLGLAFFGRLLRTGLRTDGVDAYALIKCFCLAKRTDEAVSVLLHRLSELGCVPDALSYSVVLKVLCDDSRSQRALDLLRMMSKEGGVCAPNVVPYSTVIHGFCKEGKVSKACDLFNKMGQQGVKPNVVTYTSIIDALCKARAMDKAESFLRHMVDNDVRPNNVTYKCIIQGYSSLGLWNEAVKIFREMTSRGLMLDDVTRNSFVASLCNHGRSKEAAEIAHQMIESETTVSN

SEQ ID NO: 988 - protein, 367 aa, Triticum aestivum; identical to SEQ ID NO: 987

SEQ ID NO: 989 - protein, 367 aa, Triticum aestivum; identical to SEQ ID NO: 987

SEQ ID NO: 990 - protein, 367 aa, Triticum aestivum; identical to SEQ ID NO: 987

SEQ ID NO: 991 - protein, 367 aa, Triticum aestivum; identical to SEQ ID NO: 987

SEQ ID NO: 992 - protein, 367 aa, Triticum aestivum; identical to SEQ ID NO: 987

SEQ ID NO: 993 - protein, 370 aa, Triticum aestivum
MPAARLSSFKAPSRERRPPLAALAAATERVRAGTLSRQDAHHLFDELLSQAATVPVRKLNNFLAALARAPPSTACSDGPGLAIALFNRMSRGAGARVVSPTLCTYSILIDCCCRARRPDLVVAFFGRLLRLGLLLEVISFNNLLKGLCQAKRSNEALDMLLHRTPELHCAPDVFSYNIVINGCLKEGEVDKACNLFHEMPQLGVQPDVVTYTSIMDALSKSGAMDKAEVLLRQMVDQGIEPNIKTYSYLIHGYSTFGQWKEALRVFKEMASLGVVPDVVTLTSLIDSLCKHRRTKEAREIFDSMAAKGLKPNIVSYSTMLNGYVKEGSFEDMTDLFNSMVRNGIVPNHHIFNILINAYAKRGGVKCTVGP

SEQ ID NO: 994 - protein, 356 aa, Triticum aestivum
MSRLRLRLPRGSSSPTTLIPRLRLLRRCSTSTSTSSPSRSWSPRDAFAAATERVRAGTLSLEDAHKLFDELLGQATPVPERSLNGFLAALARAPASGACIRDGPALAVALFNRVCREEAGAQVAALTVCTYNILMDCCCRARRPDLGLALFGCFLRKGLKTDQTGANTFLKCLCYAKRTDEAVNVLLHRMSELGCVPNAVSYNTVLKGLCDNSMSQRALDLLQMVAGKGGGCFPDVVAYSTVIHGFFKEGETGKACSLFHEMMQQGIVPSVVTYNSIIDALCKVREVDKAELVLRQMVAKGAQPDTVTYNCMINGYATSGRLKAGVLHQMLLLATRSWPPFASTEVAKKLQNFLIP

SEQ ID NO: 995 - protein, 331 aa, Triticum aestivum
MAPNHFVYNILISAYGQEETVGEVMHIFTKMRQEGLNPDVANYGAVINLLSSIGRMDDAKSQYNQMITEGLLPGIIVFTPLISGFCSCGKWEKVPELFSEMLDRGICPNTVFFNAIMDRLCKNGRVMEAQDLFDLMVHMGVKPDVCTYNTLIGGYLFVGKMDEVRKLLDNMVSIGLKPDVITYSILIDGYSKNGRIDDALVVSREMLAGKVKPCVITFNIMIGALLKCGRKAETKDLFDGIWANGLVPDVITYSLMIQKLIEEGSLQESDDLFLSMEKNGCVADSHMLNAIVRSLLRKGEVPRAGTYLSKIDERVFTLEASTCFRGERPRI

SEQ ID NO: 996 - protein, 411 aa, Triticum aestivum
MWASHLLDPHVIDTKVGALMHGSIVPSARASRQLTRQSVPHPPPVTLLLLLLLYLADVRLPPPLLLHFITLMSSIHLRHCSTMPMSHVCLRRRLSSSSSSFSNCTSPPSPPWSPHAAFAAATERVRARTLSPEDAHHLFDVLFQQATPVPERSLDGFLAALSRATPSEACGDGPALALTLFNRVCREEAGMQVVPPTIFTYGILMNCCCRERRPDLGLAFFGRILKAGLKTNLITANTVLKCLYCAKHTDEAVDMLLHRMSDLGCVPDDFSYNTVLHGFFKEGKIGKACNLFHEMMLQGFVPDVVTYNLIIEALCKARAMDNAELFLRQMVDNVVPPDKVTYTSMIHGYSTLGRWKEATKMFREMTSRGLIPNIVTWSSFMDSLCKHGKSKEAAEIFFSMAGKGHKPNIVS

SEQ ID NO: 997 - protein, 338 aa, Triticum aestivum
MSSIHLRHCSTMPMSHVCLRRRLSSSSSSSNCTSPPSPPWSPHAAFPAATERVRARTLSPEDAHHLFDVLFQQATPVPERSLDGFLAALSRATPSEACGDGPALALTLFNRVYREEAGMQVVPPTIFTYGILMNCCCRERPDLGLAFFGRILKAGLKTNLIAANTVLKCLYCAKHTDEAVDMLLHRMSDLGCVPDDFSYNTVLHGFFKEGKIGKARNLFHEMMLQGFVPDVVTYNLIIEALCKARAMDNAELFLRQMVDNVVPPDKVTYTSMIHGYSTLGRWKEATKMFREMTSRGLIPNIVTWSSFMDSLCKHGKSKEAAEIFFSMAGKGHKPNIVS

SEQ ID NO: 998 - protein, 338 aa, Triticum aestivum; identical to SEQ ID NO: 997

SEQ ID NO: 999 - protein, 340 aa, Triticum aestivum
MSSIHLRHCSTMPMSHVCLRRRLSSSSSSFSNCTSPPSPPWSPHAAFAAATERVRARTLSPEDAHHLFDVLFQQATPVPERSLDGFLAALSRATPSEACGDGPALALTLFNRVCREEAGMQVVPPTIFTYGILMNCCCRERRPDLGLAFFGRILKAGLKTNLITANTVLKCLYCAKHTDEAVDMLLHRMSDLGCVPDDFSYNTVLHGFFKEGKIGKACNLFHEMMLQGFVPDVVTYNLIIEALCKARAMDNAELFLRQMVDNVVPPDKVTYTSMIHGYSTLGRWKEATKMFREMTSRGLIPNIVTWSSFMDSLCKHGKSKEAAEIFFSMAGKGHKPNIVS

SEQ ID NO: 1000 - protein, 338 aa, Triticum aestivum; identical to SEQ ID NO: 997

SEQ ID NO: 1001 - protein, 392 aa, Triticum aestivum
MHGSIVPSARASRQLTRQSVPHPPPVTLLLLLLLYLADVRLPPPLLLHFITLMSSIHLRHCSTMPMSHVCLRRRLSSSSSSFSNCTSPPSPPWSPHAAFAAATERVRARTLSPEDAHHLFDVLFQQATPVPERSLDGFLAALSRATPSEACGDGPALALTLFNRVCREEAGMQVVPPTIFTYGILMNCCCRERRPDLGLAFFGRILKAGLKTNLITANTVLKCLYCAKHTDEAVDMLLHRMSDLGCVPDDFSYNTVLHGFFKEGKIGKACNLFHEMMLQGFVPDVVTYNLIIEALCKARAMDNAELFLRQMVDNVVPPDKVTYTSMIHGYSTLGRWKEATKMFREMTSRGLIPNIVTWSSFMDSLCKHGKSKEAAEIFFSMAGKGHKPNIVS

SEQ ID NO: 1002 - protein, 221 aa, Triticum aestivum
MQVVPPTIFTYGILMNCCCRERRPDLGLAFFGRILKAGLKTNLITANTVLKCLYCAKHTDEAVDMLLHRMSDLGCVPDDFSYNTVLHGFFKEGKIGKACNLFHEMMLQGFVPDVVTYNLIIEALCKARAMDNAELFLRQMVDNVVPPDKVTYTSMIHGYSTLGRWKEATKMFREMTSRGLIPNIVTWSSFMDSLCKHGKSKEAAEIFFSMAGKGHKPNIVS

SEQ ID NO: 1003 - protein, 407 aa, Triticum aestivum
MAMKGLKPDNVSYAILLHGYATEGCLVDMINLFNSMERNCILPDCCIFNILINAYAKSGKLDKAMLIFNEMQKQGVSPDAVTYLPVIDAFCKKGRLDDAMIMFNQMIDTGVRPDTAVYTSLIQGFCTHGDLVKAKELVTEMMNKGIPPPDIKFFHSIMQNLCTEGRVIEARDILGLIAHIGMRPNVCTFNILIGGYCLVRKMEDASKIFDDMMSYGLEPSNITYGILINGYCKNLRIDDGLILFKEMLRKGVKPTTFNYNVILDGLFLAGRTVAAKEKFHEMAESGADVCIDTYCIVHRSQHKKRHGRNEARPPGGRRTAGCTRAHSTTTASPRGGLAGTRSCRREDAGQPGHGNGWPGEVERMGGWEEEDASHRAVPATMARRSRGGDPRSATRRGRGEEHRHDDH

SEQ ID NO: 1004 - protein, 407 aa, Triticum aestivum; identical to SEQ ID NO: 1003

SEQ ID NO: 1005 - protein, 407 aa, Triticum aestivum; identical to SEQ ID NO: 1003

SEQ ID NO: 1006 - protein, 407 aa, Triticum aestivum; identical to SEQ ID NO: 1003

SEQ ID NO: 1007 - protein, 407 aa, Triticum aestivum
MAMKGLKPDNVSYAILLHGYATEGCLVDMINLFNSMERNCILPDCCIFNILINAYAKSGKLDKAMLIFNEMQKQGVSPDAVTYLPIIDAFCKKGRLDDAMIMFNQMIDTGVRPDTAVYTSLIQGFCTHGDLVKAKELVTEMMNKGIPPPDIKFFHSIMQNLCTEGRVIEARDILGLIAHIGMRPNVCTFNILIGGYCLVRKMEDASKIFDDMMSYGLEPSNITYGILINGYCKNLRIDDGLILFKEMLRKGVKPTTFNYNVILDGLFLAGRTVAAKEKFHEMAESGADVCIDTYCIVHRSQHKKRHGRNEARPPGGRRTAGCTRAHSTTTASPRGGLAGTRSCRREDAGQPGHGNGWPGEVERMGGWEEEDASHRAVPATMARRSRGGDPRSATRRGRGEEHRHDDH

SEQ ID NO: 1008 - protein, 405 aa, Triticum aestivum
MAMKGLKPDNVSYAILLHGYATEGCLVDMINLFNSMERNCILPDCCIFNILINAYAKSGKLDKAMLIFNEMQKQGVSPDAVTYLPIIDAFCKKGRLDDAMIMFNQMIDTGVRPDTAVYTSLIQGFCTHGDLVKAKELVTEMMNKGIPPPDIKFFHSIMQNLCTEGRVIEARDILGLIAHIGMRPNVCTFNILIGGYCLVRKMEDASKIFDDMMSYGLEPSNITYGILINGYCKNLRIDDGLILFKEMLRKGVKPTTFNYNVILDGLFLAGRTVAAKEKFHEMAESGADVCIDTYCIVHRSQHKKRHGRNEARPPGGRRTAGCTRAHSTTTASPRGGLAGTRSCRREDAGQPGHGNGWPGEVERMGGWEEEDASHRAVPATMARRSRGGDPRSATRRGRGEEHRHD

SEQ ID NO: 1009 - protein, 391 aa, Triticum aestivum
MYISSLDLKFLGVVATFLANIHILFRNFWKYLRYIFKHGAPGVYKDGSTRYSPGRAHPMPRLYPTTPMLRLLPLPSRRWDPRGAFASATERARAGTLSPEDAHHLFDELLLQANPVPERSLNGFLAALARAPSSAALRDGPSLALGLFNRVCREEAGPRVVPPTVCTYNILMDSCCRARRPDLGLAFFDRFLRMGLKADQIVANNLLKCLCHARRTHEAINVLLHRMSEFGCVPNVISYSIVLKSLCDDSRSQQAFDLLQMVRKEGGAGSLNVVAYSTVIHAFFKEGEASKACDLFHEMMQQGIVPNVVTYSSIIDALCKVRAMDKAKLVLQQMVDNGVRPNMYTWNSFMYSLCKNGRSKEAAEFFDSMTPKGLKPNIVVYSTLLHGYASE

SEQ ID NO: 1010 - protein, 391 aa, Triticum aestivum; identical to SEQ ID NO: 1009

SEQ ID NO: 1011 - protein, 391 aa, Triticum aestivum; identical to SEQ ID NO: 1009

SEQ ID NO: 1012 - protein, 391 aa, Triticum aestivum; identical to SEQ ID NO: 1009

SEQ ID NO: 1013 - protein, 391 aa, Triticum aestivum; identical to SEQ ID NO: 1009

SEQ ID NO: 1014 - protein, 391 aa, Triticum aestivum; identical to SEQ ID NO: 1009

SEQ ID NO: 1015 - protein, 391 aa, Triticum aestivum
MYISSLDLKFLGVVATFLANIHILFRNFWKYLRYVFKHGAPGVYKDGSTRYSPGRAHPMPRLYPTTPMLRLLPLPSRRWDPRGAFASATERVRAGTLSPEDAHHLFDELLLQANPVPERSLNGFLAALARAPSSAALRDGPSLALGLFNRVCQEEAGPRVVPPTVCTYNILMDSCCRARRPDLGLAFFGRFLRMGLKADQIVANNLLKCLCHARRTDEAINVLLHRMSEFGCVPNVISYSIVLKSLCDDSRSQQAFDLLQMVRKEGGAGSLNVVAYSTVIHAFFKEGEASKACDLFHEMMQQGIVPNVVTYSSIIDALCKVRAMDKAKLVLQQMVDNGVRPNMYTWNSFMYSLCKNGRSKEAAEFFDSMTSKGLKPNIVVYSTLLHGYASE

SEQ ID NO: 1016 - protein, 331 aa, Triticum aestivum
MAPNHFVYNILISAYAQEETVGEVMHIFTKMRQEGLNPDVANYGAVINLLSSIGRMDDAMSQYNQMITEGLLPGIIVFTPLISGFCSCGKWEKVPELFSEMLDRGICPNTVFFNTIMDRLCKNGRVMEAQDLFDLMVHMGVKPDVCTYNTLIGGYLFVGKMDEVRKLLDNMVSIGLKPDVITYSILIDGYSKNGRIDDALVFSREMLAGKVKPCVITFNIMIGALLKCGRKAETKDLFDGIWANGLVPDVITYSLMIQKLIEEGSLQESDDLFLSMEKNGCVADSHMLNAIVRSLLRKGEVPRAGTYLSKIDERVFTLEASTCFRGERPRI

SEQ ID NO: 1017 - protein, 331 aa, Triticum aestivum; identical to SEQ ID NO: 1016

SEQ ID NO: 1018 - protein, 331 aa, Triticum aestivum; identical to SEQ ID NO: 1016

SEQ ID NO: 1019 - protein, 363 aa, Triticum aestivum
MSELGCVPDALSYSVVLKVLCDDSRSQRALDLLQMMSKEGGGCAPNVVAYSTFIHGFCKEGKVSQACDLFDEMVQQGVKPNVVTYTSVIDALCKARAMDKAESFLRHMVNHGVRPNNVTYKYMIQGYSTLGWLKEAVKIFRETTSRGLILDDVTRNLFVASLCNHGRSKEAAEFAHQMIETGTTVSISTYSIILGELCRNNCTEEAIILFRKLGAVNVKFDITIFNTMIDAMYRVQRREEANILFAAISANGLVPNASTYRIMITSIVKEGSMEEADHMFSSMETSGYAPSSVLLNDIIRMLLEKGEIVKAGNYLSKVDGKCISLEASTGLLMMHLFSREGKYHEQIRSLPARYEFFGVSTVE

SEQ ID NO: 1020 - protein, 363 aa, Triticum aestivum
MSELGCVPDALSYSVVLKVLCDDSRSQRALDLLQMMSKEGGGCAPNVVAYRTFIHGFCKEGKVSQACDLFDEMVQQGVKPNVVTYTSVIDALCKARAMDKAESFLRHMVNHGVRPNNVTYKYMIQGYSTLGWWKEAVKIFRETTSRGLILDDVTRNLFVASLCNHGRSKEAAEFAHQMIETGTTVSISTYSIILGELCRNNCTEEAIILFRKLGAVNVKFDITIFNTMIDAMYRVQRREEANILFAAISANGLVPNASTYRIMITSIVKEGSMEEADHMFSSMETSGYAPSSVLLNDIIRMLLEKGEIVKAGNYLSKVDGKCISLEASTGLLMMHLFSREGKYHEQIRSLPARYEFFGVSTVE

SEQ ID NO: 1021 - protein, 363 aa, Triticum aestivum; identical to SEQ ID NO: 1019

SEQ ID NO: 1022 - protein, 363 aa, Triticum aestivum; identical to SEQ ID NO: 1019

SEQ ID NO: 1023 - protein, 363 aa, Triticum aestivum; identical to SEQ ID NO: 1020

SEQ ID NO: 1024 - protein, 363 aa, Triticum aestivum; identical to SEQ ID NO: 1019

SEQ ID NO: 1025 - protein, 368 aa, Triticum aestivum
MIDTGVRPDTAVYRSLIQGFCTHGDLVKAKEYVTEMMNKGMLPPDIMFFSSIMQNLCTEGRVIEARDILDLMVHIGMRPDVPIFNLLIGGYCLVCKMEDATKVFDDMVSYGLEPCNITDGMLINGYCKNRRIDDGLILFKEMLHKGLKPTTFNYNVILDGLFLAGRTVAAKEKFNEMVESGVSMCISTYSIVLGGLCRNSCSSEAITLFQKLSTMNVKFDIRIVNIMIGAFYRVRRNQEAKDLFAAIPSNGLAANVVTYSIMIINLIKEGSVEEADNLFLSMEKSGCTADSCMLNHIIRRLLEKGEMVKAGNYISKVDANSYSLEAKTVSLLISLFSRKGKYREHITLLPTKYQFREEAATVELFDTW

SEQ ID NO: 1026 - protein, 368 aa, Triticum aestivum; identical to SEQ ID NO: 1025

SEQ ID NO: 1027 - protein, 368 aa, Triticum aestivum; identical to SEQ ID NO: 1025

SEQ ID NO: 1028 - protein, 368 aa, Triticum aestivum; identical to SEQ ID NO: 1025

SEQ ID NO: 1029 - protein, 368 aa, Triticum aestivum; identical to SEQ ID NO: 1025

SEQ ID NO: 1030 - protein, 368 aa, Triticum aestivum; identical to SEQ ID NO: 1025

SEQ ID NO: 1031 - protein, 396 aa, Triticum aestivum
MREKGVSPDVVTYTTVIAALSRMGRLTDAVDKFDEMIAMGVQPSIPVYQSLIQGFCIDGDLVKAKELVSEMMNKGIPCPNIVFFNSVINSLCKEGRVMDAHDIFDLVIDIGERPDTITFSSLIDGYCLVGKMDKAFGMLNAMESVGVEPDIVTYSTLLDGYFKNGRIDDGLTLFREMPRKRIKPDTVTYGIILDGLFRSGRTVAAWKMFHEMIESGTTVTFSIYAIILGGFCRNNCADEAITLFHKLGAMNVKFNIAIVNTMINAMYKVGRREEAKELFAGILARGLVPNESTYGVMIKNLLKDGVVEDANNVFSSMDKSGIVPSSRLINDIIRLLLEKGEIAKAGYYLSKVDGKSISLEASTTSLMFSLFSMKGKYKEHMKLLPAKYQFFDELVD

SEQ ID NO: 1032 - protein, 277 aa, Triticum aestivum
MIKCNTEANDKTTTTNNWKTPGATVSGRYTDIVTYSTLLDGYFKNGRIDDGLTLFREMPRKRIKPDTVTYGIILDGLFRSVRIVAAWKMFHEMIESGTTVTFSIYAIILGGFCRNNCADEAITLFHKLGAMNVKFNIAIVNTMINAMYKVGRREEAKELFAGILARGLVPNESTYGVMIKNLLKDGAVEDANNVFSSMDKSGIVPSSRLINDIIRLLLEKGEIAKAGYYLSKVDGKSISLEASTTSLMFSLFSRKGKYKEHMKLLPAKYQFFDELVD

SEQ ID NO: 1033 - protein, 396 aa, Triticum aestivum; identical to SEQ ID NO: 1031

SEQ ID NO: 1034 - protein, 396 aa, Triticum aestivum; identical to SEQ ID NO: 1031

SEQ ID NO: 1035 - protein, 396 aa, Triticum aestivum; identical to SEQ ID NO: 1031

SEQ ID NO: 1036 - protein, 396 aa, Triticum aestivum; identical to SEQ ID NO: 1031

SEQ ID NO: 1037 - protein, 396 aa, Triticum aestivum; identical to SEQ ID NO: 1031

SEQ ID NO: 1038 - protein, 396 aa, Triticum aestivum
MDPTARIEGQYSTVIHTFCKKGRLDDAVIKFNQMIDTGVRPDTAVYSSLIQGFYTHGDLVKAKEYVTEMMKKGMLPPDIKFFHSIMQNLCTEGRVIEARDVLGLIAHIGMRPDVCTFNILIGGYCLVGKMEDASKIFDDMMSYGLEPSNITYGILINGYCKNRRIDDGLILFKEMLHKGLKPTTFNYNVILDGLFLAGRTVAAKEKFDEMVESGVSVCIGTYSTVLGGLCRNNCSGEAITLFQKLSTMDVKFNIIIVNIMIDAFYKVQRNQEAKDLFAAVSANGLVANVFTYTIMMKNLIKEGSVGEADDLFLSMEKSCCTADSYMLNLIVRMLLGKGEIVKAGNYISKIDAKSYSLEAKTVSLLISLFSGKGKYREHIGLLHTKYPFREEAATVV

SEQ ID NO: 1039 - protein, 396 aa, Triticum aestivum
MDPTARIEGQYSTVIHTFCKKGRLDDAVIKFNQMIDTGVRPDTAVYSSLIQGFYTHGDLVKAKEYVTEMMKKGMLPPDIKFFHSIMQNLCTEGRVIEARDVLGLIAHIGMRPDVCTFNILIGGYCLVGKMEDASKIFDDMMSYGLEPSNITYGILINGYCKNRRIDDGLILFKEMLHKGLKPTTFNYNVILDGLFLAGRTVAAKEKFDEMVESGVSVCIGTYSTVLGGLCRNNCSGEAITLFQKLSTMDVKFNIIIVNIMIDAFYKVQRNQEAKDLFAAVSANGLVANVFTYTIMMKNLIKEGSVEEADDLFLSMEKSGCTADSYMLNLIVRMLLGKGEIVKAGNYISKIDAKSYSLEAKTVSLLISLFSGKGKYREHIGLLPAKYRFREEAATVV

SEQ ID NO: 1040 - protein, 395 aa, Triticum aestivum
MVSLGQKPTVTTYSILLHGYAMEQSFHEMHCLIDLMVGNGIAPNHFVYNILISAYAQEETVGEVMHIFTKMRQEGLNPDVANYGAVINLLSSIGRMDDAMSQYNQMITEGLLPGIIVFTPLISGFCSCGKWEKVDELFSEMLDRGICPDTVFFNTVMDHLCKNGRVIEAQDLFDLMVHMGVKPFVRDYNTLIHGYCLVGKMDEGRKLLDNMCSIGLKPDDFTYSILIDGYSMKGRIGDALIVVREMLDRKVKPSIITFNIMIGALLKGGRKEEAKDLFDGIWAKGLVPDVVTYRLMIQKLIEEGSLQDSDDLFLSMEKNGCVADSRMLNAIVRSLLQKGDVPRAGTYLSKIDERRFTFEASTASLLTSLASGGKGQEYKELLPEEYHSFLEQGTG

SEQ ID NO: 1041 - protein, 395 aa, Triticum aestivum; identical to SEQ ID NO: 1040

SEQ ID NO: 1042 - protein, 395 aa, Triticum aestivum; identical to SEQ ID NO: 1040

SEQ ID NO: 1043 - protein, 374 aa, Triticum aestivum
MEQSFHEMHCLIDLMVGNGIAPNHFVYNILISAYAQEETVGEVMHIFTKMQQEGLNPDVANYGAVINLLSSIGRMDDAMSQYNQMITEGLLPGIIVFTPLISGFCSCGKWEKVDELFSEMLDRGICPDTVFFNTVMDHLCKNGRVIEAQDLFDLMVNMGVKPFVRDYNTLIHGYCLVGKMDEGRKLLDNMCSIGLKPDDFTYSILIDGYSMKGRIGDALIVVREMLDGKVKPSIITFNIMIGALLKGGRKEEAKDLFDGIWAKGLVPDVVTYRLMIQKLIEEGSLQESDDLFLSMEKNGCVADSRMLNAIVRSLLQKGDVPRAGTYLSKIDERRFTFEASTASLLTALASGGKGQEYKELLPEEYHSFLEQGTG

SEQ ID NO: 1044 - protein, 374 aa, Triticum aestivum
MSRLRLLRRSSSSTTLIPRLRLLRRCSTSTSTSPPSGPWSPRDAFVAAIERVRAGTLSPEDAHHLFDDLLGQATPVPDRTMNGVLARATSPAACIRDGPALAVALFNRVCREEAGPHVAAPTVHTYGILMDCCCRARRPDLGLALFGRFLRTGLKANEIVATTFLKCLCCAKRTEEAVKVLLHRMPELGCVPNAISYSIVLKSLCENSMSQQALDLLQMATKEGGCLPDVVAYSAIIHGFFKEGEIDKACHLFHEMMRQGVVPTVVTYNIIIDALCKAGEMDKAELVFQRMARNGARPNKATCNGSKFSSLTDGYCSVAKMDKTFKLLDAMISVGIEPDAVTYSALLDGYFKNGRIDDGLTLFREMSCELNLQL

SEQ ID NO: 1045 - protein, 374 aa, Triticum aestivum; identical to SEQ ID NO: 1044

SEQ ID NO: 1046 - protein, 374 aa, Triticum aestivum
MSRLRLLRRSSSSTTLIPRLRLLRRYSTSTSTSPPSGPWSPRDAFVAAIERVRAGTLSPEDAHHLFDDLLGQATPVPDRTMNGVLARATSPAACIRDGPALAVALFNRVCREEAGPHVAAPTVHTYGILMDCCCRARRPDLGLALFGRFLRTGLKANEIVATTFLKCLCCAKRTEEAVKVLLHRMPELGCVPNAISYSIVLKSLCENSMSQQALDLLQMATKEGGCLPDVVAYSAIIHGFFKEGEIDKACHLFHEMMRQGVVPTVVTYNIIIDALCKAGEMDKAELVFQRMARNGAQPNKATCNGSKFSSLTDGYCSVAKMDKTFKLLDAMISVGIEPDAVTYSALLDGYFKNGRIDDGLTLFREMSCELNLQL

SEQ ID NO: 1047 - protein, 374 aa, Triticum aestivum; identical to SEQ ID NO: 1044

SEQ ID NO: 1048 - protein, 374 aa, Triticum aestivum; identical to SEQ ID NO: 1044

SEQ ID NO: 1049 - protein, 374 aa, Triticum aestivum; identical to SEQ ID NO: 1044

SEQ ID NO: 1050 - protein, 374 aa, Triticum aestivum; identical to SEQ ID NO: 1044

SEQ ID NO: 1051 - protein, 351 aa, Triticum aestivum
MKLKMPGPGGIITLVSNPYIALRAENKTAALALEALSEALAAEELTALRSTVNRDDVILDKRSKSTSFKPADEIVKFQVHPTDPTKTTSIRAQLNPVVDAALREFLRENWDIFAWHPSDMPGIPRRLAEHSLNILKGVINNLSKEGNVKDAQDMFDFIVGIGHQPDVIMYNSLMDGYCLVGKVEEAMTVLDAMKSAGLQPDAITYAILLNGYCKIGRIDDGLSLFREISLSRVKPTTIMYNIILDGLFCCGRTVFAKEEFDTMIESGIPVGIDTCTIVLSGLCKNNCTDEAIELFKKLCAMNVKFDVIILTTMISAMFKTRRIEEAKDLFATISTIGLVPSVVTYSVIFFF

SEQ ID NO: 1052 - protein, 314 aa, Triticum aestivum
MDCCCRARRPDLGPAFLGRLLRTGLKTNQIVANTLLKCLCYAKRTDEAVNVLLHKMSELGCVPDAISYNTVLKSLCEDSRSQEALDLLWMVAKEGGVGSLDVVSHSTVIHGFFKEGETGKACNLFHEMTHQGIVPNVMTYNLIIAALCKARAMDKAELILRQMVDNGVRPNTVTCSSLMSSLCKHGRSKEAAEIFDSMTAKGLKPDIVAYSILLHGYATEGCLADMIDLFNSMKNNGIEATCQVFNILIGAYAKCGMMDEAMLIFTEMRRQGVSPDVFTYTTVIVSLFRTSRLADAIDKFDEMIAIGVQPNRPV

SEQ ID NO: 1053 - protein, 314 aa, Triticum aestivum; identical to SEQ ID NO: 1052

SEQ ID NO: 1054 - protein, 314 aa, Triticum aestivum
MDCCCRARRPDLGPAFLGRLLRTGLKTNQIVANTLLKCLCYAKRTDEAVNVLLHKMSELGCVPDAISYNTVLKSLCEDSRSQEALDLLWTVAKEGGVGSLDVVSHSTVIHGFFKEGETGKACNLFHEMTHQGIVPNVMTYNLIIAALCKARAMDKAELILRQMVDNGVRPDTVTCSSLMSSLCKHGRSKEAAEIFDSMTAKGLKPDIVAYSILLHGYATEGCLADMIDLFNSMKNNGIEATCQVFNILIGAYAKCGMMDEAMLIFTEMRRQGVSPDVFTYTTVIVSLCRTSRLADAIDKFDEMIAIGVQPNRPV

SEQ ID NO: 1055 - protein, 314 aa, Triticum aestivum; identical to SEQ ID NO: 1052

SEQ ID NO: 1056 - protein, 314 aa, Triticum aestivum; identical to SEQ ID NO: 1052

SEQ ID NO: 1057 - protein, 259 aa, Triticum aestivum
MSELGCVPDAISYNTVLKSLCEDSRSQEALDLLWTVAKEGGVGSLDVVSHSTVIHGFFKEGETGKACNLFHEMTHQGIVPNVMTYNLIIAALCKARAMDKAELILRQMVDNGVRPDTVTCSSLMSSLCKHGRSKEAAEIFDSMTAKGLKPDIVAYSILLHGYATEGCLADMIDLFNSMKNDGIEATCQVFNILIGAYAKCGMMDEAMLIFTEMRRQGVSPDVFTYTTVIVSLFRTSRLADAIDKFDEMIAIGVQPNRPV

SEQ ID NO: 1058 - protein, 314 aa, Triticum aestivum; identical to SEQ ID NO: 1052

SEQ ID NO: 1059 - protein, 366 aa, Triticum aestivum
MCKAGAMDKTELVLRPMVDNGVRPDKMICNSMIHGYSTLGRWKEAGKVFREMTSRGLIPDIFTWNSFMGSLCKHGRSKEAAEIFFSMAAKGHKPNIVSYILLLRVYANEGRFADMMSLLNLMEGDGIVANCQIFTILIDAYAKQGMIDEAMLVLTDMRGQGLSPDVFTYSALLSALCRMGRLADAMDKFTQMIGTGVQPNTVVYHSLVQGLCTHGDLAKAKELVSKMMNKGIARPNIALFSSIMASLCNEGRVMDAHHIFDLVTDIGEKPNIIMFTTLIDGYCLVGKMDKACGVLDAMVSAGIEPNVVTYSTLVSGYCKNGRIDNGLILFRDMLRTAAAKKMFREIIESRIIVSISTYNIILGMTL

SEQ ID NO: 1060 - protein, 366 aa, Triticum aestivum; identical to SEQ ID NO: 1059

SEQ ID NO: 1061 - protein, 366 aa, Triticum aestivum; identical to SEQ ID NO: 1059

SEQ ID NO: 1062 - protein, 366 aa, Triticum aestivum; identical to SEQ ID NO: 1059

SEQ ID NO: 1063 - protein, 366 aa, Triticum aestivum
MCKAGAMDKTELVLRPMVDNGVRPDKMICNSMIHGYSTLGRWKEAGKVFREMTSRGLIPDIFTWNSFMGSLCKHGRSKEAAEIFFSMAAKGHKPNIVSYILLLRVYANEGRFADMMSLLNLMEGDGIVANCQIFTILIDAYAKQGMVDEAMLVLTDMRGQGLSPDVFTYSALLSALCRMGRLADAMDKFTQMIGTGVQPNTVVYHSLVQGLCTHGDLAKAKELVSKMMNKGIARPNIALFSSIMASLCNEGRVMDAHHIFDLVTDIGEKPNIIMFTTLIDGYCLVGKMDKACGVLDAMVSAGIEPNVVTYSTLVSGYCKNGRIDNGLILFRDMLRTAAAKKMFREIIESRIIVSISTYNIILGMTL

SEQ ID NO: 1064 - protein, 366 aa, Triticum aestivum; identical to SEQ ID NO: 1059

SEQ ID NO: 1065 - protein, 375 aa, Triticum aestivum
MPRLRRFSTVPMLHLLRRSSSSTSTSLPSHPWSPHEAFAAATERVRAGTLTPEEAHNLFDGFPGPQPLPERLPCRPRPCAGLRNLPQRWPCPRPCPLQPRMPRRSRPAGGILMGCFCGAHRPDLGLALFGRFLGTGLKTNKIVATTFLKCLCYAKRTDEAVNLLLRRMPELGCVPDAISYTIVLKSLCENSMSQRALDLLQMVAEGGGACSLNVVVYSTVIHGFFKEGETGKACNLFHEMIHQGVVPNVVTYSSIIDALCKARAMDKAELVLQQMVDSGAQPNNVTYNCMIHGYSTSGQLKEAAKMFRKMTSHGLVPNAVTCSSLMTSLCKHGRSKEAAEIFYSMTAKGHKPDAVSYRILLHGYANEGCFADMID

SEQ ID NO: 1066 - protein, 389 aa, Triticum aestivum
MFDVYKKCAKRREELLLGRPLVHTSVGLEMTSSPMCRIGLRHRRSSSSTSLMSRLRLLGRSSSSTSTSPRSRPWSPHAAFAAATQRVSAGTFSPEHAHQLFDELLRQGTPVPDFSLDGFLAALARATSSAACRDGPALALALFNRLCREEAGPRVAQPTIFTYGVLMNCCVRTRRPQLGLAFFGRVLRTDLKTNTIVFSSLLKCLCHAKRTDEDVSVLLHRMPELGCVPDAFSYTIVLKSLCDDSSSQRALDLLQTMEKGGGVCSPDVVSYTTVIHGLLKEGEVSKACSLFDEMVQQGVVPNVVTYSSIIDALCKAGVMDKTELVLRQMVDSGIQPDNVTYTSMIHGYSTLGRWKEADKPGYHTRCCYLDLIHDLPLQAWKKQRSCRNY

SEQ ID NO: 1067 - protein, 344 aa, Triticum aestivum
MKRTEEALNVLLHKMPNDLPNVISYSVILKSFCDNGRSQLALDLLQMMAKKGADHSPDVMSYNMVIDGFFKEGEVSKACDLFQEMIRQGIVPTEVTYSSIINALCKARAMDKAEVVLRSMVHNGAQPDAVTYNSLIQGYSTLGQLKEVARLLKVMRSQGVMPSVVTYNLLMTCLCKHGKTKEAEKIFYSMAVNGRKPDVISYSILLHGYAKEGSLIDMIDLCERMARDGVVPNLHCFNILINAYAKHGMMGVALLFFEDMLKQGVKPSEFTYLTVISAFCKMGRMDDAMEKFREMIDMGVPVDTEVYMCIVEGYFKNGDSVKAKDFITKMKNKDIPNRPQKGNY

SEQ ID NO: 1068 - protein, 344 aa, Triticum aestivum; identical to SEQ ID NO: 1067

SEQ ID NO: 1069 - protein, 344 aa, Triticum aestivum; identical to SEQ ID NO: 1067

SEQ ID NO: 1070 - protein, 344 aa, Triticum aestivum; identical to SEQ ID NO: 1067

SEQ ID NO: 1071 - protein, 344 aa, Triticum aestivum; identical to SEQ ID NO: 1067

SEQ ID NO: 1072 - protein, 267 aa, Triticum aestivum
MKRTEEALNVLLHKMPNDLPNVISYSVILKSFYDNGRSQLALDLLQMMAKKGADHSPDVMSYNMVIDGFFKEGEVSKACDLFQEMIRQGIVPTEVTYSSIINALCKARAMDKAEVVLRSMVHNGAQPDAVTYNSLIQGYSTLGQLKEVARLLKVMRSQGVMPSVVTYNSLMTCLCKHGKTKEAEKIFYSMAVNGRKPDVISYSILLHGYAKEGSLIDMIDLYERMARDGVVPNLHCFNILINAYAKHGMMDVALLFFEDMLKQGDEA

SEQ ID NO: 1073 - protein, 251 aa, Triticum aestivum
MSTARLCSTFTSSLKAPSRKPRAPRLAALAAATERVRAGTLTRQDAHKLFDKLLSQAATVPVRKLNNFLAALARAPPSAACSDGPGLAIALFNRMSRGAGARVASPTLCTYSILMDCCCRAGRPDLVLAFFSRLLRLGLSLNVISFSNLLKGLCQAKRSNEALDMLLHRTPELHCAPDVFSYNIVINGCLKEGEVDKACNLFHEMPQLGVQPDVVTYTSIMDALSKSGAMDKAEVLLRQMVDQGIEPNIKT

SEQ ID NO: 1074 - protein, 305 aa, Triticum aestivum
MGHVIKLGFTAEAIVNFNHLLKAICAEKKTSYAMDIVLRVMPEFNCTPNIFSYYILFKGLCNEKRSQEALELIQIMVEDGGCCRPDVVTYSTVIDGLLKEGEVDQAYSLFSEMLRQGVSPNIVTCNSIISGMCKLHAMDKAEEVLQQMFDRRILPDVATYTSLIHGYYSLGQCKEVDRILNEMCKHGVQPDIVTYNIQMDYLCKSGRCAEARNLLDSLIGLGQKPDVTTYSILLHGYAMEKSFDEMHCLIDLMVGNGVAPDHHIYNILISAYAKEETVGEVMDIFTKMRQQGLNPDVERIACSGD

SEQ ID NO: 1075 - protein, 305 aa, Triticum aestivum; identical to SEQ ID NO: 1074

SEQ ID NO: 1076 - protein, 305 aa, Triticum aestivum; identical to SEQ ID NO: 1074

SEQ ID NO: 1077 - protein, 329 aa, Triticum aestivum
MFEMMNGGILRPNIVFFNSVINSLYKEGRVMDAHDVLDLVIGIGERPDTITFSSLIDGYCLVGKTDKAFKILDAMESVGVEPDIVTYNTLLDGYFKNRRIDDALTLFREMPRKRIKPGTVTYGIMLDGLFRAGRTVAAKKMFHEMNESGTTVDISTYAIILGGFCRNNCADEAITLFHKLGAMNVKFNIAIVNTMINAMYKVGRREEAKELFAGILARGLVPNESTYGVMIKNLLKDGAVEDANNVFSSMDKSGIVPSSRLINDIIRLLLEKGEIAKAGYYLSKVDGKSISLEASTTSLMFSLFSRKGKYKENMKLLPAKYQFFDVLVD

SEQ ID NO: 1078 - protein, 304 aa, Triticum aestivum
MFEMMNGGILRPNIVFFNSVINSLYKEGRVMDAHDVLDLVIGIGERPDTITFSSLIDGYCLVGKTDKAFKILDAMESVGVEPDIVTYNTLLDGYFKNRRIDDALTLFREMPRKRIKPGTVTYGIMLDGLFRAGRTVAAKKMFHEMNESGTTVDISTYAIILGGFCRNNCADEAITLFHKLGAMNVKFNIAIVNTMINAMYKVGRREEAKELFAGILARGLVPNESTYGVMIKNLLKDGAVEDANNVFSSMDKSGIVPSSRLINDIIRLLLEKGNEKNSALQNIARPFSKCYTSYSALIACYISK

SEQ ID NO: 1079 - protein, 334 aa, Triticum aestivum
MNRSRAMKGLTAARRVTASVETTALSGLLSMTPEEACHRQVLDLVIGIGERPDTITFSSLIDGYCLVGKTEKAFKILDAMESVGVEPDIVTYNTLLDGYFKNRRIDDALTLFREMPRKRIKPGTVTYGIMLDGLFRAGRTVAAKKMFHEMNESGTTVDISTYAIILGGFCRNNCADEAITLFHKLGAMNVKFNIAIVNTMINAMYKVGRREEAKELFAGILARGLVPNESTYGVMIKNLLKDGAVEDANNVFSSMDKSGIVPSSRLINDIIRLLLEKGEIAKAGYYLSKVDGKSISLEASTTSLMFSLFSRKGKYKENMKLLPAKYQFFDVLVD

SEQ ID NO: 1080 - protein, 329 aa, Triticum aestivum; identical to SEQ ID NO: 1077

SEQ ID NO: 1081 - protein, 329 aa, Triticum aestivum; identical to SEQ ID NO: 1077

SEQ ID NO: 1082 - protein, 236 aa, Triticum aestivum
MDCCCRAHRLDLAFAFFGRLLRTGLKAGVIQVCTLLKGLCRAKRADEALDVLLHRMPELGGCTPNVVAYTTVIHGFFKEGQISKACYLFHEMALQGVTPDVVTYSSVIDALCKARAMDKAEYFLRQMVHNGVLPNNVTYNSLIHGYSSSGHWKEAVRVLKEMTSQGIIPDIVSYRILLHGYATEGCLVDMINLFNSMARYCILPDCHIFNILINAYAKSGKLDKAMLIFKECRNKE

SEQ ID NO: 1083 - protein, 315 aa, Triticum aestivum
MARLCYTTPMPHLRRCCSSSTSPPSRHWDPRPAFAAATERVRAGTLSPEDAHHLFDELLLQANPVPERSFNDFLAALARALSSAALRDGHSLALGIFNRVCREEAGPCVTPPTVCTYNILMDSCCRACHPNLGPAFFGRFLRTGLKADQIVAINLLKCLCHAKRKDEAVNMLLHRMSEFGCVPDAISYSIVLKSLCDDSRSQQALDLLQMVRKGGACSLDVVAYSTVIRSFFKEGEVSKACNLFHEMVQQGIVPNVVTYSLIIDALCKVRAMDKAKLVLQQMVDNGVRPNMYTCMELIHVLPLQEWRKQRSCRIF

SEQ ID NO: 1084 - protein, 315 aa, Triticum aestivum; identical to SEQ ID NO: 1083

SEQ ID NO: 1085 - protein, 315 aa, Triticum aestivum; identical to SEQ ID NO: 1083

SEQ ID NO: 1086 - protein, 315 aa, Triticum aestivum; identical to SEQ ID NO: 1083

SEQ ID NO: 1087 - protein, 315 aa, Triticum aestivum
MARLCYTTPMPHLRRCCSSYTSPPSRHWDPRPAFAAATERVRAGTLSPEDAHHLFDELLLQANPVPERSFNDFLAALAQALSSAALRDGHSLALGIFNRVCREEAGPCVTPPTVCTYNILMDSCCRACHPNLGPAFFGRFLRTGLKADQIVAINLLKCLCHAKRKDEAVNMLLHRMSEFGCVPDAISYSIVLKSLCDDSRSQQALDLLQMVRKGGACSLDVVAYSTVIRSFFKEGEVSKACNLFHEMVQQGIVPNVVTYRLIIDALCKVRAMDKAKLVLQQMVDNGVRPNMYTCMELIHVPPLQEWRKQRSCRIF

SEQ ID NO: 1088 - protein, 315 aa, Triticum aestivum; identical to SEQ ID NO: 1083

SEQ ID NO: 1089 - protein, 315 aa, Triticum aestivum; identical to SEQ ID NO: 1083

SEQ ID NO: 1090 - protein, 360 aa, Triticum aestivum
MTAKGHRANVVSYCILLHGYGNEGCFADMIDLFNSMERNGIAADCRVFNILIDAYAKHGMTDEAMLIFTEMREKGAGPDAFTYSTVIAALSRMGRLTDAMGKFSQMIAMGVQPDTTVYHSLIQGCCLHGDLVKAKELVCEMMNKGIPRPSIVFFNSVINSLCKEGRIMDAHDIFDLVIDIGERPDAITFSSLIDGYCLVGNMDKALKVLDVMESVGVEPNVITYNTLVNGYCRNGRIDDSLTLFREMPRKRIKPDTVSYCIIMNGLFRAGRTVAARKMFHEMTENGITVSISTYSIILRGLCRNNCADEAITLFQKLGTMNVKFDIAILNTMINAMYKGSKKGRSKGIVCYNISQWVGAQ

SEQ ID NO: 1091 - protein, 334 aa, Triticum aestivum
MASVGVQPNAVTLNSLIDSLCKHRRTKEAREIFDSMAAKGLKPNIVSYSTMLNGYVKEGCFDDMTDLFNSMVRNGIVPNHHIFNILINAYAKRGVMDEAMHMFEVMRQQGVNPDVFSYQIVMDSLRKMGRMDAALDKFNQMVNQGVSPNIVVYQCLVLGSCSHGDFVKAKELISEAVNRGLCSNSVFFYSVINDLCKEGKVKEAQDMFHFIVGIGQRPDVIMYTSLMDGYCLVGKVEEALRVLGAMKSAGLQPTAVTYGILLNGYCKIGRIAAGLSLFKEMSLSGVKPTTIFFRENAKEFAFHFIEQEENSSTGTTSQKEGHTHTHHRPHQTSR

SEQ ID NO: 1092 - protein, 381 aa, Triticum aestivum
MLFAKKGRLDDAVIKFNQMIDAGVRPDASVYRSLIQGFCTHGDLVKAKEYVTEMMKKGMLPPDIMFFSSIMQKLCTEGRVIEARDILDLIVRIGIRPDVFIFNILIGGYCLVRKMADASKIFDDMVSYGLEPCNSTYGILINGYCKNGRIDDGLILFKEMLPKGLKPTTFNYNVILDGLFLAGQTVAAKEKFDEMVESGVSVCIDTYSIVLGGLCRNNCAGEAITLFQKLSTTNVKFDIRIVNIMIDAFYRVRRNQEAKDLFAAVSANGLVANVFTYTVMMINLIEEGSLEEADTLFLSMERSGCTANSYMLNHIIRRLLERGEIVKAGNYMSKVDAKSYSLEAKTVSLLISLFLGKGRYREHMKLLPMKYQFLEEAATVE

SEQ ID NO: 1093 - protein, 381 aa, Triticum aestivum; identical to SEQ ID NO: 1092

SEQ ID NO: 1094 - protein, 381 aa, Triticum aestivum; identical to SEQ ID NO: 1092

SEQ ID NO: 1095 - protein, 381 aa, Triticum aestivum; identical to SEQ ID NO: 1092

SEQ ID NO: 1096 - protein, 333 aa, Triticum aestivum
MVDEVMHIFTKMRQQGLNPDVENYGAVVNLLSKIGRMDDAMSQFNQMITEGLAPDVIVFTPLISGFCSCGKWEKVDELFSEMLDRGICPDTVFFNTVMDHLCKNGRVIEAQDVFDLMVHMGVKPDVRSHVTLMHGYFADGKMDEMRKLLENMCSIGLKPDVVTYSILIDSYSKNGRIDDALVVFREMLDGVKPSIITFNIMIGVLLKGSRKEEAKDLFDGIWAKGLVPDVVTYSLMIQNLIEEGSLQESDDLFISMEKNGCAANSCMLNAIVRSLLQKEEILRAGTYLSKIDERRFTLEASTASLLTALVSGGEGQEYKELLHEKYSELLIEA

SEQ ID NO: 1097 - protein, 375 aa, Triticum aestivum
MTAKGLKPDIVVYCTLLHGYATEGCLADMINLFNSMEDNGIVANCKVFTILIDGYAKCGMIDEAMLIFTKMREQGVSPNVFTYAIVTAALCRMGRLSDAMDKLNEMIAMGLQPNKVVYRSLIQGFCTHGDLVKAKVLVSEMMNKGIPRPNMVFFNSVINSLCKEGRVTDAHDIFDLAINIGERPDVITFNSLIDGHCLAGKMDKAFGVLDAMVSAGIEPNVVTYNTLIDGYSRKGRIDDGLTLFREMMPNKIKPTTATYGAILHGLFRAGRTSPAKKMFNEMIESETTVNISIYAIILGGLCRNNCVDEAIVLFEKLGAMNVKLDVGIFNTMINAMYAVKGREEAKDLFAAISANGLVPNASSYGVMITNLLRED

SEQ ID NO: 1098 - protein, 360 aa, Triticum aestivum
MSRRFVPVDRRILERNIKARYHAGDIGTQDALHLFDELIQVAGPSSVRAINCLLTVVGRDCPALGVSLFNRVARTKVPPHNVTYGILVDCCCRAGRLDLGHAAMGRVIKLGFTAEAIVNFSHLLKAICAEKKTSYAMDIVLRIMPEFNCMPNIFSYNILFKGLCNEKRSQEALDLIQIMVEDGGCCRPDVVTYSTVIDGLLKEGEVGKAYRLFSEMLQRGISPNAVTYSSIICGMCRLHLMDKAEEVLQQMFDREILPDVATYTSLIHGYYSLGQCEEVDRIFKEMSRNGVQPDIVTYNIQMDYLCKNGRCAEARKIFDSMVSLGQKPTVTTYSILLHGYAIERFLIPCPGVDPLVGQLG

SEQ ID NO: 1099 - protein, 342 aa, Triticum aestivum
MSRIHLHRCLYSSTSRPLRSWSPRAAFAAATERVRAGALSQDDAHHLFDELLRQATPVPGRSLNGFLAALARAPASEVCRDGPALALALFNRVCRDEAGAPLTVHTYGILMGCCCRGHRPDLGLALFGRLHRTGIKTNQIAVNTFLKCLCYAKRTDEAVNVLLHRMSELGCVPNAFSYSIVLKSLCYNSMSQRALDLLQMMAKEGGACSPNVVTYTTVIHGLFKEGETGKACNLFHEMKQQGIEPNVVTYTSSIDALCKARAMDKAELVLRQMVANGAQPNEVTYNCMIHGYSTSGQLKEAAKMFREMTSQGLIPDNFTCSSLMTSLCKHQRSKEAAEIFMP

SEQ ID NO: 1100 - protein, 374 aa, Triticum aestivum
MGRMDAALDKFNQMVNQGVSPNKAVYQCLVLGSCSHGHFVKAKELISEAVNRGLCSNSVFFYPVINDLCKEGKVKEAQDMFDFIVGIGQRPDVIMYNSLMDGYCLVGKVEEALRVLDAMKSAGLQPTAVTYGILLNGYCKIGRIAAGLSLFMEMSLSGVKPTTIMYNIILDGLFRSGRTDSAKEKFRTMSESGIPVGIDTYNIVLSGLCKNNCAGEAIELFKKLRAMNVKIDVKTLTIMISAMFKSRRIEEAKELFATISAIGLVPSVVTYSVMMTNFIKEGSLAETDDMFLAMEKASCAPDSILLNQVVRALLEKGAVVKAATYLAKLDAKQLSVEASTISLIVSLFSGEGKLREHVELLPVKYQPPESSTDN

SEQ ID NO: 1101 - protein, 295 aa, Triticum aestivum
MFDFIVGIGQRPDVIMYNSLMDGYCLVGKVEEALRVLDAMKSAGLQPTAVTYGILLNGYCKIGRIAAGLSLFMEMSLSGVKPTTIMYNIILDGLFRSGRTDSAKEKFRTMSESGIPVGIDTYNIVLSGLCKNNCAGEAIELFKKLRAMNVKIDVKTLTIMISAMFKSRRIEEAKELFATISAIGLVPSVVTYSVMMTNFIKEGSLAETDDMFLAMEKASCAPDSILLNQVVRALLEKGAVVKAATYLAKLDAKQLSVEASTISLIVSLFSGEGKLREHVELLPVKYQPPESSTDN

SEQ ID NO: 1102 - protein, 374 aa, Triticum aestivum; identical to SEQ ID NO: 1100

SEQ ID NO: 1103 - protein, 370 aa, Triticum aestivum
MISLGVVPNAIMWNSFMDSLCKHRRTKEARDIFDSMAAKGQKPDIFSYSTMLNGYAKEGCFDDMTCLLNLMLQNGVVPNHHIFNILINAYAKPGLMDEAMHMFEVMRQQGVNPDVFDYQIIMDSLYKMGRMDATLDKFNQMVNQGVSPNKAVYQCLVLGSCFHGHFLKAKELISEAVNRGMCSNSMFFYPVINDLCKGKVEEAQDIFDFILGIGQRPDVTMYNSLMDGYCLVGKVEEALRVLDAMKSAGLQPDAITYAILLNGYCKIGKITDGLSLFREMSLSGVKPTTIMYNIILDGLFCSGRTVSAKEKFNTMVESGLPVDVCTYNIVLCGLYKNNCTGEAIELFKKLRAINMKIDVIILNTIISLIF

SEQ ID NO: 1104 - protein, 351 aa, Triticum aestivum
MEKSFHDMHCLIDLMVENGIAPDHHVYNILISACAQEEMVSDVMHIFTKMRQQGLNPNVANYGVVVNLLCSMGRMDDAMYQYNQMITEGLDPDIIVFSTLISGFCSCGAWERVHEIFSEMLNRGIYPDTVFFNIIMDHLCKEGRVMEAQDIFDLMVHMGVKPFVRDYNTLIHGYCLVGKMDEGRKLLDNMCSIGLKPDDFTYSILIDGYSMKGRIDDALIVVRELLDGKVGPSIITFNIMIVALLKGGRKEEAKDLFDGIWAKGLVPDVVTYSLMIQKLIEEGSLQESDDLFLSMEKNGCAADSRMLNDIVRSLLQKGTMQVSMEYATEASLARLPFKIYHALREATKMPS

SEQ ID NO: 1105 - protein, 225 aa, Triticum aestivum
MMSKGIPRPNIVFFNSVINYLCKEGRVMDAQDIFEFIISIDERPDVITFNSLIDGYCLVSKMDKASGVLDAMVSAGIEPNVVTYNTLVSGYSINRRIDDGLTLFRQMPLKRIKPDSVTYGIILDGFFRAGRTVAARKMFHEMIERGIPVTISIYNRILGGLCRNNCADEAIALFQKLGAMNVKFDIITLNTMINACSRFEEEKKLTICLLQYQPVGWCLMLLLTA

SEQ ID NO: 1106 - protein, 325 aa, Triticum aestivum
MMSKGIPRPNIVFFNSVINYLCKEGRVMDAQDIFEFIISIDERPDVITFNSLIDGYCLVSKMDKASGVLDAMVSAGIEPNVVTYNTLVSGYSINRRIDDGLTLFRQMPLKRIKPDSVTYGIILDGFFRAGRTVAARKMFHEMIERGIPVTISIYNRILGDLCRNNCADEAIALFQKLGAMNVKFDIITLNTMINAMFKVRRREEANDLFAAISASGLVPNASTYGIMIKNILKEGSVEEIDNMFSSMEKSGIVPSSHLINDIIRMLLEKGEIARAGYYLLKVDGKNTLLEASTTSLMLSLFSREGKYQEDVKLLPAKYQFFYGFG

SEQ ID NO: 1107 - protein, 325 aa, Triticum aestivum; identical to SEQ ID NO: 1106

SEQ ID NO: 1108 - protein, 225 aa, Triticum aestivum; identical to SEQ ID NO: 1105

SEQ ID NO: 1109 - protein, 325 aa, Triticum aestivum; identical to SEQ ID NO: 1106

SEQ ID NO: 1110 - protein, 325 aa, Triticum aestivum; identical to SEQ ID NO: 1106

SEQ ID NO: 1111 - protein, 358 aa, Triticum aestivum
MIMVFHQIIMATTYSYLLMLKKKMVDDVLHIFTKMRQQGLNPDVANYGAVINLLSSIGRMDDAMSQYNQMINEGLAPDIIVFNSLISGFCSCGKWEKVHELFSEMLDRGICPNTVFFTTIMDRLCKNGRVMEAQDLFDLMVHMGVKPDVWTYNTLIGGYLFIGKMDEVSKLLDNMCSIGLKPNVFTYGILIDGYSKNGSIDDALVVIREMLDGVKPSIITFNIMIGVLLKGSRMEEAKDLFDGIWAKGLVPDVVTYSLMIQKLIEEGSLQESDDLFVSMEKNGCAADSCMLNAIVRRLLQKGEILMAGTYLSKIDERRFSFEASTASLLAALVSGGKGQEYKELLPEKYHYFLEQGTD

SEQ ID NO: 1112 - protein, 358 aa, Triticum aestivum; identical to SEQ ID NO: 1111

SEQ ID NO: 1113 - protein, 344 aa, Triticum aestivum
MAKGDDCSPCVLSYSTVIHGFFKEGEVGMACNLFHEMTQQGVVPNVVTYNSIIDAMCKAGAMDKTELVLRQMVDNGVRPDKVIYNSMIHGYSTLGRWKEAGKMFREMTSRGLIPDIFTWNSFMGSLCKHGRSKEAAEIFFSMAAKGYKTNIVSYIALLRVYANEGSFADMMSLFNSMEGNGIVANCQVFTILIDAYAKQGMIDEAMLILTDMRGQGLSPDVFTYSTLISALCRMGRLADAMDKFSQMIGMGVQPNTVVYHSLVQGLCTHGDLAKAEELVSEMMNKGIARPNKSLASSFLYHYSISGSIRRVGANPAYIRVSICQHISVCDNPAETIRCSCHPSF

SEQ ID NO: 1114 - protein, 325 aa, Triticum aestivum
MMNKGIPRPSIVFFNSVINSLCKEGRIMDAHDIFDLVIDIGERPDAITFSSLIDGYCLVGNMDKALKVLDVMESVGVEPNVITYNTLVNGYCRNGRIDDSLTLFREMPRKRIKPDTVSYCIIMNGLFRAGRTVAARKMFHEMTENGITVSISTYSIILRGLCRNNCADEAITLFQKLGTMNVKFDIAILNTMINAMYKVGRREEAKDLFAAISHSGLVPNESTYKVMIKNLLKDGAVEDADNMFSSMDNSGIVPSSLLINDIIRMLLEKGEIAKAGNYLSKVDGKSISLEASTASLMLSLFSRKGKHQEDIKLLPAKYQFFDGFG

SEQ ID NO: 1115 - protein, 325 aa, Triticum aestivum; identical to SEQ ID NO: 1114

SEQ ID NO: 1116 - protein, 325 aa, Triticum aestivum; identical to SEQ ID NO: 1114

SEQ ID NO: 1117 - protein, 325 aa, Triticum aestivum; identical to SEQ ID NO: 1114

SEQ ID NO: 1118 - protein, 325 aa, Triticum aestivum; identical to SEQ ID NO: 1114

SEQ ID NO: 1119 - protein, 325 aa, Triticum aestivum; identical to SEQ ID NO: 1114

SEQ ID NO: 1120 - protein, 253 aa, Triticum aestivum
MIIVHMVIVHMVKKTLIQGYCTHGDLVKAMGLVSEMINRGIPPPDIVFFNSVINSLCKEGRVTDAQDTFDLVIYFGERPDIFTFNSLIDGYCLVGEMEKAFGVLDTMASGGIEPDSISYNTIVNGYFKNDRIDDGLALFREMLKKVKPTTVTYNIILDGLFGAGKTVAAKKTFHEMIESGITVSISTYRIILGGLCRNSCDDEAITLFQKLGAMNVKLDITILNTMINALFKVQRREEANNLFATVSASVDCF

SEQ ID NO: 1121 - protein, 330 aa, Triticum aestivum
MRLVSEMINRGIPPPDIVFFNSVINSLCKEGRVTDAQDIFDLVTYFGERPDIFTFNSLIDGYCLVGEMEKAFGVLDTMASGGIEPDSISYNTIVNGYFKNDRIDDGLALFREMLKKVKPTTVTYNIILDGLFGAGKTVAAKKTFHEMIESGITVSISTYRIILGGLCRNSCDDEAITLFQKLGAMNVKLDITILNTMINALFKVQRREEANNLFAAVSASGLVPNAYTYCIMITNLIKEGSVEEAENMFLLMEKSSCAPDSRLINCIIRILLEKGEIVKAGNYMSKVDGKSISLEASTTSLLIHLFASKGKYQEQINLLPVKYRFFEGVS

SEQ ID NO: 1122 - protein, 330 aa, Triticum aestivum; identical to SEQ ID NO: 1121

SEQ ID NO: 1123 - protein, 330 aa, Triticum aestivum; identical to SEQ ID NO: 1121

SEQ ID NO: 1124 - protein, 253 aa, Triticum aestivum; identical to SEQ ID NO: 1120

SEQ ID NO: 1125 - protein, 330 aa, Triticum aestivum; identical to SEQ ID NO: 1121

SEQ ID NO: 1126 - protein, 324 aa, Triticum aestivum
MMNRGIPRPNIVFNSVINSLCKEGRVMDAHDVLDLVIGIGERPNVITFNSLIDGYCLVGNMDKAFKILDVMESVGVEPNVVTYSALLDGYSKNRRIDDALTLFREMPRKRIKPDTVTYGIMLDGLFRAGRTVAAMEMFHEMTESGTTVDIVIYNIILGGLCRNNCVDEAIALFQKLRAMNVKFNIEILNTMINAMYKVQRKEEAKELFATISANGLVPNESTYAVMIRNLLRGGAVEDADNMFSSMDNSGIVPSSGLINDIIRMLLKKGEIAKAGNYLSKVDGKSISLEASTTALLLSLFSRKGKHQVDIKLLPAKYQFFDGFG

SEQ ID NO: 1127 - protein, 346 aa, Triticum aestivum
MPRLQVRSFCSSFSSRAYDLLNELQGHLDSRTLRPELARQLFDEMLRQPVPVTARALNGLFAALARAPPSTACTDGPALAVDLFNHMARAGRRRMTGPTVHTYNILIDCCHRACRPDLGPAFFGCLLKTGITMSAITYSSLFKFLCDMRRTKEALNVLLHRMPDDLPNVISYSVILKSFCDSGRSQLALDLLRVMAKKGGDHSPDVMAYNMVMDGLFKEGEVSKACDLFHEMIQQGVVPNEVTYSSIINALCKARAMDKAEVILRHMVRNGVQPHDSRIYNTLIHGFLTSDQLKEAFRLLKVMRSHGSMPNVVTCTSVMDYLCKHGRIKEAEEIFYSMAVNGRNQI

SEQ ID NO: 1128 - protein, 345 aa, Triticum aestivum
MPRLQVRSFCSSFSSRAYDLLNELQGHLDSRTLRPELARQLFDEMLRQPVPVTARALNGLFAALARAPPSTACTDGPALAVDLFNHMARAGRRRMTGPTVHTYNILIDCCHRACRPDLGPAFFGCLLKTGITMSAITYSSLFKFLCDMRRTKEALNVLLHRMPDDLPNVISYSVILKSFCDSGRSQLALDLLRVMAKKGGDHSPDVMAYNMVMDGLFKEGEVSKACDLFHEMIQQGVVPNEVTYSSIINALCKARAMDKAEVILRHMVRNGVQPHDRIYNTLIHGFLTSDQLKEAFRLLKVMRSQGSMPNVVTCTSVMDYLCKHGRIKEAEEIFYSMAVNGRNQI

SEQ ID NO: 1129 - protein, 345 aa, Triticum aestivum
MPRLQVRSFCSSFSSRAYDLLNELQGHLDSRTLRPELARQLFDEMLRQPVPVSARALNGLFAALARAPPSTACTDGPALAVDLFNHMARAGRRRMTGPTVHTYNILIDCCHRACRPDLGPAFFGCLLKTGITMSAITYSSLFKFLCDMRRTKEALNVLLHRMPDDLPNVISYSVILKSFCDSGRSQLALDLLRVMAKKGGDHSPDVMAYNMVMDGLFKEGEVSKACDLFHEMIQQGVVPNEVTYSSIINALCKARAMDKAEVILRHMVRNGVQPHDRIYNTLIHGFLTSDQLKEAFRLLKVMRSQGSMPNVVTCTSVMDYLCKHGRIKEAEEIFYSMAVNGRNQI

SEQ ID NO: 1130 - protein, 345 aa, Triticum aestivum; identical to SEQ ID NO: 1128

SEQ ID NO: 1131 - protein, 345 aa, Triticum aestivum; identical to SEQ ID NO: 1129

SEQ ID NO: 1132 - protein, 301 aa, Triticum aestivum
MLRQPVPVSARALNGLFAALARAPPSTACTDGPALAVDLFNHMARAGRRRMTGPTVHTYNILIDCCHRACRPDLGPAFFGCLLKTGITMSAITYSSLFKFLCDMRRTKEALNVLLHRMPDDLPNVISYSVILKSFCDSGRSQLALDLLRVMAKKGGDHSPDVMAYNMVMDGLFKEGEVSKACDLFHEMIQQGVVPNEVTYSSIINALCKARAMDKAEVILRHMVRNGVQPHDRIYNTLIHGFLTSDQLKEAFRLLKVMRSQGSMPNVVTCTSVMDYLCKHGRIKEAEEIFYSMAVNGRNQI

SEQ ID NO: 1133 - protein, 345 aa, Triticum aestivum; identical to SEQ ID NO: 1129

SEQ ID NO: 1134 - protein, 346 aa, Triticum aestivum
MPRLQVRSFCSSFSSRAYDLLNELQGHLDSRTLRPELARQLFDEMLRQPVPVSARALNGLFAALARAPPSTACTDGPALAVDLFNHMARAGRRRMTGPTVHTYNILIDCCHRACRPDLGPAFFGCLLKTGITMSAITYSSLFKFLCDMRRTKEALNVLLHRMPDDLPNVISYSVILKSFCDSGRSQLALDLLRVMAKKGGDHSPDVMAYNMVMDGLFKEGEVSKACDLFHEMIQQGVVPNEVTYSSIINALCKARAMDKAEVILRHMVRNGVQPHDSRIYNTLIHGFLTSDQLKEAFRLLKVMRSHGSMPNVVTCTSVMDYLCKHGRIKEAEEIFYSMAVNGRNQI

SEQ ID NO: 1135 - protein, 346 aa, Triticum aestivum; identical to SEQ ID NO: 1134

SEQ ID NO: 1136 - protein, 213 aa, Triticum aestivum
MSAITYSSLFKFLCDMRRTKEALNVLLHRMPDDLPNVISYSVILKSFCDSGRSQLALDLLRVMAKKGGDHSPDVMAYNMVMDGLFKEGEVSKACDLFHEMIQQGVVPNEVTYSSIINALCKARAMDKAEVILRHMVRNGVQPHDRIYNTLIHGFLTSDQLKEAFRLLKVMRSQGSMPNVVTCTSVMDYLCKHGRIKEAEEIFYSMAVNGRNQI

SEQ ID NO: 1137 - protein, 345 aa, Triticum aestivum; identical to SEQ ID NO: 1128

SEQ ID NO: 1138 - protein, 345 aa, Triticum aestivum; identical to SEQ ID NO: 1129

SEQ ID NO: 1139 - protein, 346 aa, Triticum aestivum; identical to SEQ ID NO: 1134

SEQ ID NO: 1140 - protein, 325 aa, Triticum aestivum
MMNKGIPRPDIAFFTSIINSLCKEGRVMDAQNIFDLLVAIDERPNVITFNSLIDGYCLVGEMDKVFRVLDAMKSVGAEPDIVTYNTLVNGYCRNGRIDDDLALFREMPCKGIKPDTVAYCIILDGLFHAGRIVVARKMFHEMIESGTTVGIPIYNITLKGLSRNNCAHEAIAMFQKLGAMNVKFDIVTLNTMINALYKVGKKEEAKDLFAAISASGLVPNASTYSIMIINYLKEGSVEDANNIFSSMEKSGIAPSSRLINYIIRIYLEKGEIAKAGDYLSKVDGKNILLEASTTSLMLSLFSRNGKYQENIKLLPAKYQFFYGFG

SEQ ID NO: 1141 - protein, 325 aa, Triticum aestivum; identical to SEQ ID NO: 1140

SEQ ID NO: 1142 - protein, 325 aa, Triticum aestivum
MMNKGIPRPDIAFFTSIINSLCKEGRVMDAQNIFDLLVAIDERPNVITFNSLIDGYCLVGEMDKVFRVLDAMKSVGAEPDIVTYNTLVNGYCRNGRIDDDLALFREMPCKGIKPDTVAYCIILDGLFHAGRIVVARKMFHEMIESGTTVGIPIYNITLKGLSRNNCAHEAIAMFQKLGAMNVKFDIVTLNTMINALYKVGRKEEAKDLFAAISASGLVPNASTYSIMIINYLKEGSVEDANNIFSSMEKSGIAPSSRLINYIIRIYLEKGEIAKAGDYLSKVDGKNILLEASTTSLMLSLFSRNGKYQENIKLLPAKYQFFYGFG

SEQ ID NO: 1143 - protein, 325 aa, Triticum aestivum
MMNKGIPRPDIAFFTSIINSLCKEGRVMDAQNIFDLLVAIDERPNVITFNSLIDGYCLVGEMDKVFRVLDAMKSVGAEPDIVTYNTLVNGYCRNGRIDDDLALFREMPCKGIKPDTVAYCIILDGLFHAGRIVVARKMFHEMIESGTTVGIPIYNITLKGLSRNNCAHEAIAMFQKLGAMNVKFDIVTLNTMINALYKVGKKEEAKDLFAAISASGLVPNASTYSIMIINYLKEGSVEDANNIFSSMEKSGIAPSSRLINYIIRIYLERGEIAKAGDYLSKVDGKNILLEASTTSLMLSLFSRNGKYQENIKLLPAKYQFFYGFG

SEQ ID NO: 1144 - protein, 325 aa, Triticum aestivum; identical to SEQ ID NO: 1140

SEQ ID NO: 1145 - protein, 325 aa, Triticum aestivum; identical to SEQ ID NO: 1140

SEQ ID NO: 1146 - protein, 325 aa, Triticum aestivum; identical to SEQ ID NO: 1140

SEQ ID NO: 1147 - protein, 284 aa, Triticum aestivum
MHSNEALDLLLHRMPELDCAPDVFSFNIVINGCFREGEVDKACNLFHEMPQLGVQPDVVTYNSIIIALSRAGAMGKAEVVLRQMVDKGIGPDVMTYNSLIHGYSTLGQWKAAVRVFKEMVSVGVLPNAVTLNSFMDSLCKHRRTKEARDIFDSMAAKGHKPNIASYSTMLNGYAKQGCFDDMTGLFNSMLQNGVVPNHHIFNILINAYAKRGLMDEAMHMFEVMRQQGVNPDVFSYQIVMDSLCKWVGWMLLWTNLIRWSIKEFHLTKLFTNAWFWVLVLMVIL

SEQ ID NO: 1148 - protein, 328 aa, Triticum aestivum
MMNKGIPRPDIMFFHSIMQNLCTEGRVVEARDILGLIAHIGMRPNVCTFNILIGGYCLVRKMEDASKIFHDMMPYGLEPSNITYGILINGYCKNLRIDDGLILFKEMLRKGLKPTTLNYNIILDGLFLAGRTAAAKEKFDEMVESGADVCIDTYCIVLGGLCRNNCYSEAIMLFQKLSAMNVKFDITVVNIIIGAFYRVQRNQEAKDLFVAIPANGLVPNSVTYTIMMRNLIKEGSVEEADNLFLSMENSGCTANSNMLNLIVRMLLEKGEIVKAGNYMSKVDAKSYSLEAKTVSLLISLFSGKGKYREHIGLLPTKYQFREEAATVV

SEQ ID NO: 1149 - protein, 280 aa, Triticum aestivum
MPAARLSSFKAPSRERRPPLAALAAATERVRAGTLSRQDAHHLFDELLSQAATVPVRKLNNFLAALARAPPSAACSDGPGLAIALFNRMSRGAGARVVSPTLCTYSILMDCCCRARRPDLVVAFFGRLLRLGLRLEVISFSNLLKGLCQAKRTNEAVDLLLHRTPELDCVPDVVSYNIVINGCLKEGEVDKACNLFHEMPQLGVQPDVVTYNSIIDALSKSRAMDKAEVVLRQMVDQGIGPDVMTYTSLIHGYSTSGQWKEAVRLFKKMTSLGALPYRHV

SEQ ID NO: 1150 - protein, 330 aa, Triticum aestivum
MPDDLPNAISYSVILKSFCDSGRSQLALDLLQMMAKKGADHSPDVVAYNMVIDGFFKEGEVSKACDLFHEMIQQGVVPTVVTYNSVIDALCKARAMDKAEVVLRSMVHNGVHPNTVTYNSLIQGYSTLGQLKEVARLLKVMRSQGVMPSVVTYNSLMDYLCKHGRIKEAEEIFYSMAVNGRRPDIVSYSIMLHGYAIEGSLVEMIDLCELMARDGVVPDLRCFNILINAYAKYGRMDVAMLFFEDMLKQGVKPNEFTYLTVISAFCKMGRMDDAMEKFSEMIDIGVPLDTEVYMCMVEGYFNHGDSMKAEEFITRMKNKDINHKPWEGNR

SEQ ID NO: 1151 - protein, 330 aa, Triticum aestivum; identical to SEQ ID NO: 1150

SEQ ID NO: 1152 - protein, 330 aa, Triticum aestivum; identical to SEQ ID NO: 1150

SEQ ID NO: 1153 - protein, 330 aa, Triticum aestivum; identical to SEQ ID NO: 1150

SEQ ID NO: 1154 - protein, 250 aa, Triticum aestivum
MPAARLSSISTSSFRAPSRAPLAALAAATERVRAGTLSQDDAHHLFDQLLGQAAAVPERGLNNFLAALARAPPSAACRDGPGLAIALFNRMSRGAGARVASPTLCTYSILMDCCCRAGRPDLVLAFFGRLLRLGLRLDIISSSNLLKGLCQAKRSNEALDMLLHRMPELDCVPDVFSYSIVINGCFKQGEVDKACNLFHQMPQLGVQPNVVIYNSVIDALSKSGAMDKAEVVLGKWLIKELNPISRHITV

SEQ ID NO: 1155 - protein, 250 aa, Triticum aestivum; identical to SEQ ID NO: 1154

SEQ ID NO: 1156 - protein, 324 aa, Triticum aestivum
MLQRGISPNVVTCNSIISGMCKVHAMDKAEEVLQQMTDRGILPDVATYTSLIHGYYSLGQCKEVDRIFKEMTRNGVQPNVVTYSIQMDYLCKSGRCAEARKIFDSMVSLGQKPSVTTYSILLHGYVMEKSFHDMHCLLDFMVENGISPDHHVYNILISAYAKEEMASEVMHIFTKMRQQGLNPSVADYGAVINLLSSIGRMDDAMSQFNQMIAEGLAPDIIVFNPLISGFCTCGKWEKVHELFSEMLNRGTYHDTVFFTTIMDRLCKNGRVMESQDMFDLMVHVGVKPNVHTYATLMHGYFFVRKMDEVRKLVGNMLSIGSKPD

SEQ ID NO: 1157 - protein, 282 aa, Triticum aestivum
MALPSPRMAQAGRRQVPAPSIYTYNILIDCCHRACRPDLGPAFFGRLLNTGITMSVITYISLFKCLCDMKRTEEALNVLLHRMPDDLPNVISYSVILKSFCDSGRSQLALDLLQMMAKKGADHSPDAMSYNIVIDGFFKEGEVSKACDLFHEMMQQGVVPDMATYNSVIDALCKARAMDKAEVVLRSMVHNGVQPDVVTYNSLIQGYSTLGQLKEVARLLKVMRSQGVMPSVVTYNSLMDYLCKHGRIKEAEEILDSMAVNGRKPDLILYYAPWVRYRRIPC

SEQ ID NO: 1158 - protein, 282 aa, Triticum aestivum; identical to SEQ ID NO: 1157

SEQ ID NO: 1159 - protein, 282 aa, Triticum aestivum; identical to SEQ ID NO: 1157

SEQ ID NO: 1160 - protein, 282 aa, Triticum aestivum; identical to SEQ ID NO: 1157

SEQ ID NO: 1161 - protein, 282 aa, Triticum aestivum; identical to SEQ ID NO: 1157

SEQ ID NO: 1162 - protein, 282 aa, Triticum aestivum; identical to SEQ ID NO: 1157

SEQ ID NO: 1163 - protein, 254 aa, Triticum aestivum
MPRLRLRRFSTAPMFHLLRRSSSSTTTSPPSRSWSPHAAFAAATERISAGTLSREDAHRLFDELLRQATPVPSRSLNGFLAALARATSSAACIRDGRALAIALFNRVCREQSGPRVVPLTVHTYNILMDCCCRASRPDLGLAFFARLLRTGLKTNEITANTFLKCLCYAKRTDEALNVLLHRMSELGCVPDAISYNIVLKSLCEDSMSQRALDLLQMMAKEGGGCSPNVVAYNTVIHGFFKEGETGKDAICSMK

SEQ ID NO: 1164 - protein, 254 aa, Triticum aestivum; identical to SEQ ID NO: 1163

SEQ ID NO: 1165 - protein, 254 aa, Triticum aestivum; identical to SEQ ID NO: 1163

SEQ ID NO: 1166 - protein, 325 aa, Triticum aestivum
MRQQGLNPNVVNYGAVINLLSSIGRMDDAMSQFNQMITEGLAPDIIVFNSLISGFCSCGKWEKVHELFSEMLDRGICPDRVFFNTVMDHLCKNGRVMEAQDVFDLMVHMGVKPFVRDYNTLIHGYCLVGKMDEGRKLLDNMFSIGLKPGDFTYSILIDGYSKKGRIDDALIIVRVMLDGKVKPSIITFNIMIGALLKGGRKEEAKDLFNGIWAKGLVPDVVTYSLMIQKLIEEGSLQESDDLFLSMEKNGCAADSRMLNAIVRSLLQKGDVPRAGTYLSKIDERSFTLEGSTASLLTALASGRKGQEYKGLLPEKYHYFLEQGTD

SEQ ID NO: 1167 - protein, 319 aa, Triticum aestivum
MPRFSSTTSMSPLRLRLRLHARHSSASQPSRSQGWDPHAAFAAATQRARSGSLTPADAHHLFDELLRQANPVQERPLNNLLAAIVRAPASNACRNGPALAVALFSRISQGARRRVAQPNVFTYGVLMDCCCRARRLDLAIAFFGRLLKTGLEADLVFFSTLLKGLCHAKRSDEALDVLLHRMPELGCTPDVVVYNTVIHGFFREGQVGKACDMFHGMAQQGVAPNVVTYNSVIDALCKARAMDKAEYFLRQMVDNGVVPDNVTYNSLIHGYSSSGHQKETLRVLKEMTSQGIIPDVVTCNSLMAYLCKNGRSKEAAEFF

SEQ ID NO: 1168 - protein, 321 aa, Triticum aestivum
MPRRLPLALLPLHTKAMPRLSSTTPMSPLRLRLRARHSSSTSHSSRSWEPHTAFAAATERARSGNLTPEDAHHLFDELLRQANPVQERPLNNLLAALARAPASAACSDGLALAVNLFSRISQGARCVAHPTACTYGILMDCCCRAHRLDLAFAFFGRLLRTGLKAGVIQVCTLLKGLCHAKRTDEALNVLLHRMTELGCTPDVVAYNTVIHGFFKEGQVGKACSLFHEMAQQGVAPNLMTYTSVIDALCKAKAMDKAEYFLRQMVDNGVVPDNVTYNSLIHGYSSSGHWKEAVRVSKEMTSRRVTADVHTYNMFMTFLCKH

SEQ ID NO: 1169 - protein, 321 aa, Triticum aestivum; identical to SEQ ID NO: 1168

SEQ ID NO: 1170 - protein, 321 aa, Triticum aestivum; identical to SEQ ID NO: 1168

SEQ ID NO: 1171 - protein, 321 aa, Triticum aestivum; identical to SEQ ID NO: 1168

SEQ ID NO: 1172 - protein, 321 aa, Triticum aestivum; identical to SEQ ID NO: 1168

SEQ ID NO: 1173 - protein, 321 aa, Triticum aestivum; identical to SEQ ID NO: 1168

SEQ ID NO: 1174 - protein, 212 aa, Triticum aestivum
MDSCCRARRPDLGLAFFGRFLRTGLKADLIVASTLLKCLCHVRRTNEAVNMLLHRMSEFGCVPDAISYSIVLKSLCDNSRSQQALDLLQMVRKERGASSLNVVAYSIIIHGFFKEGEVSKACDLFHEMMQQGIVPDVVKYRSVIDALCKVRAMDKAKLVLQQMVNNGVRPNMYTWNSFMYSLCKHGRSKEAAEFFDSMVETARVLPGLGRSL

SEQ ID NO: 1175 - protein, 311 aa, Triticum aestivum
MKFSAVPSLVECLTSAGHPVSSGLSSPTRSHIRHCRKEQDLPRLTRSSSSSGSSRVNQLLNKLKDYLGSGTLRPELAHQLFVELFRQTVPVSADALNVLFSALACGLPSAACNDGPALAIALFKHMARARCRQVMAPTNHTYNTLIECCHMARRPDIGLVFFGLLLKIGITADVFTFNSLLKCLCDMKQTDEALGVLLHRMPGDMPDVISYSVIIKSFCDNGRSHRALDLLRMMTKKGYDHSPNVVSYTIIIDGLIKEGELSKACALFHEMMQQGVVPDVVTYSSIIDGLCKARALDEAEVVLRQMIDSGV

SEQ ID NO: 1176 - protein, 311 aa, Triticum aestivum; identical to SEQ ID NO: 1175

SEQ ID NO: 1177 - protein, 311 aa, Triticum aestivum; identical to SEQ ID NO: 1175

SEQ ID NO: 1178 - protein, 311 aa, Triticum aestivum; identical to SEQ ID NO: 1175

SEQ ID NO: 1179 - protein, 311 aa, Triticum aestivum; identical to SEQ ID NO: 1175

SEQ ID NO: 1180 - protein, 311 aa, Triticum aestivum; identical to SEQ ID NO: 1175

SEQ ID NO: 1181 - protein, 268 aa, Triticum aestivum
MRPCRTPLLDSTSPLSVLLLDHLHRNRPSPPPSASPPSAIWSPIAAFAAATKRARAGTLSPEDAHHLFDELLRQSIPVPNRFLNGFLAALARAPVSEACGDGPALTVALFNRLCREEAGPCVEPPTYYTYSILMDSCCRVGRPDLGLAFFGRLLKSGLKADQITASSLLMCLCDAGRTNEAVDVLLHRISELGCEPNVIPYNIVLKSLCDSSRSQRALDLLQMMAQRACCSPNVVSYNTVIQGLFKEGQVSMARTFFFYEMMGLCLMW

SEQ ID NO: 1182 - protein, 268 aa, Triticum aestivum; identical to SEQ ID NO: 1181

SEQ ID NO: 1183 - protein, 268 aa, Triticum aestivum; identical to SEQ ID NO: 1181

SEQ ID NO: 1184 - protein, 268 aa, Triticum aestivum; identical to SEQ ID NO: 1181

SEQ ID NO: 1185 - protein, 268 aa, Triticum aestivum; identical to SEQ ID NO: 1181

SEQ ID NO: 1186 - protein, 268 aa, Triticum aestivum; identical to SEQ ID NO: 1181

SEQ ID NO: 1187 - protein, 321 aa, Triticum aestivum
MDYLCKSRRCAEARTIFDSMAGKDQKPNVTSYSILLHAYAMEQSFHDMHCLIELMVENGVAPNHSVYNILIDAYAKGKMVDDVMHIFTKMRQQGLNPNAVNYGTVINLLCSIGRMDDAMLQFNQMITEELVPDIIVFNTLISGFFSCGKWEKVHELLAEMLNRGIYPDNVFFNTIMDHLCKNGRVMESQDLADLMIHMGLKPDVHTYNTLMGGYFFIGKMDEVRKLLDHMVSIGMEPDVVTYNTLIDGYFKNGMIDDALAVFSEMLDKKVKPCVITYNTVLHGLFHTGRTVAANELYLRMIDSGICVDIVTYNNSAYVVST

SEQ ID NO: 1188 - protein, 321 aa, Triticum aestivum; identical to SEQ ID NO: 1187

SEQ ID NO: 1189 - protein, 321 aa, Triticum aestivum; identical to SEQ ID NO: 1187

SEQ ID NO: 1190 - protein, 321 aa, Triticum aestivum; identical to SEQ ID NO: 1187

SEQ ID NO: 1191 - protein, 321 aa, Triticum aestivum; identical to SEQ ID NO: 1187

SEQ ID NO: 1192 - protein, 321 aa, Triticum aestivum; identical to SEQ ID NO: 1187

SEQ ID NO: 1193 - protein, 303 aa, Triticum aestivum
MLRRIRIRIRLRRRPYPSCTYPEPVLCHSSSFISAAPLLRLHQYRTTTTPMSRIHLRRRLFSSTTRPSHSWSPHAAFAAATKRVRTGALSQDDAHHLFDELLRQATPVPGRSLNGFLAALARAPASGACRDGPALALALFNRVCRDESGARVAPPTIFTYGILMNCCCRAHRPDLGLAFLARLLRTGLKADQITATTFLKCLCYAKRTDEAVNVLLHRMPELGCVPDAFAYSTVLKSLCDNSMSQRGLDLLHMMAKEGGGCSPNVVACSTVIHGFFKEGETGKACNLFHEMMQQGVEPNVWTY

SEQ ID NO: 1194 - protein, 303 aa, Triticum aestivum; identical to SEQ ID NO: 1193

SEQ ID NO: 1195 - protein, 303 aa, Triticum aestivum; identical to SEQ ID NO: 1193

SEQ ID NO: 1196 - protein, 287 aa, Triticum aestivum
MLDRGICPDTVFFNTVMDHLCKNGRVMEAQDVFDLMVHMGVKPFVYDYNTLIHGYCLVCKMDEERKLLDNMFSIGLKPDDFTYSILIDDYSKKGRIDDALIIVREMLDGKVKPSIITFNIMIGVLLKGGIKEEAKDLFDGVWAKGLVPDVVTYRLMIQKLIEEGSLQESDDLFLSMEKNGCVADSHMLNATVRSLLQKGEVPMAGTYLSKIDERRFTFEAPTASLLTALASGGKARNIRSYSLKNTTLFWNRALVETISRDFAYIFWTAIRGLNFSLWVTSPNLLFS

SEQ ID NO: 1197 - protein, 287 aa, Triticum aestivum; identical to SEQ ID NO: 1196

SEQ ID NO: 1198 - protein, 287 aa, Triticum aestivum; identical to SEQ ID NO: 1196

SEQ ID NO: 1199 - protein, 293 aa, Triticum aestivum
MFDFIVGIGQRPDVIMYNSLMDGYCLVGKVEEALRVLDAMKSAGLQPDAFTYGILLNGYCKIGRIAAGLSLFMEMSLSRVKPTTIMYNIILDGLFRSGRTVSAKEKFRTMSESGIPVGIDTYNIVLNGLCKNNCTDEAIELFKKLRATNVKIDVITFSTMISAMFKTRRIEEAKDLFATISAIGLVPSVVTYSLMMTNFIKEGLLADADDMFLAMEKAGCAPDSRLLNQVVRVFLKNGEVVKAVTYLAKLDAKQLSVEASTISLIVSLFSRKGKLREHVKLLPVKYQPPEMLG

SEQ ID NO: 1200 - protein, 293 aa, Triticum aestivum; identical to SEQ ID NO: 1199

SEQ ID NO: 1201 - protein, 293 aa, Triticum aestivum; identical to SEQ ID NO: 1199

SEQ ID NO: 1202 - protein, 293 aa, Triticum aestivum; identical to SEQ ID NO: 1199

SEQ ID NO: 1203 - protein, 293 aa, Triticum aestivum; identical to SEQ ID NO: 1199

SEQ ID NO: 1204 - protein, 293 aa, Triticum aestivum; identical to SEQ ID NO: 1199

SEQ ID NO: 1205 - protein, 284 aa, Triticum aestivum
MHGDLVKVKELIFEMTDKGIPHPNIVFFSSIMHSLCNEGRVMDAHHIFDLVIDIGERPDLITFNTLIDRYCLVSKMEEALRLLDSMVSAGIKPNVITYNTLINGYRSGRLDDGVILFREMLHTRVKPNTVTYNIILDGLFRAGRTVSAKKMFHEMIETGTAVSISTYSIVLGGLCRNNCTDEAIAFFQKLVAMNVMFNIAILNTIIKAMYTVQRREEANDLFASLPAYGLVPNAATYGVMISNLLKEGSLEEADNMFSSMEKRGCAPSSRLVMISSENYWKRGR

SEQ ID NO: 1206 - protein, 289 aa, Triticum aestivum
MPRLSSTTTTPMSPLRLRLRLRARHSASTSHSSRSWEPHAAFAAAAERARSGNLTPEDAHDLFDELLRQGNPVQERPLNKLLSALARAPASAACRNGPALAVNLFSRISQGARLRVAQPTACTYGVLMDCCCRAHRLDLTLAFFGGLLRTGLEADQVIFCTLLKGLCHAKCTDEALNVLLHRMPELGCTPNVVAYNTVIHGFFREGQVGKACNLFHEMRQQGVTPDVVTYNSVIDVLCMLVDLGSDRVKSNVKGMSQEPTFVAFDPNRIALIGGTSNRQMVLVPYCQRI

SEQ ID NO: 1207 - protein, 289 aa, Triticum aestivum; identical to SEQ ID NO: 1206

SEQ ID NO: 1208 - protein, 300 aa, Triticum aestivum
MPNVVTYSLMVGGLCKVGARDKAKLVLRHMVGNSVRPDMYTWNSFMGSLRKQGRSKEATQLFDYMAAKGHKPDVVMYSTLLHGYATEGCFTDMINRFNSMEGNGIVANSRVFNILIDAYAKRGMMHEAMLIFTEMREQRVSPDTFTYGIIIAALCRMGRLSDAMEKLNEMVATGLQPDEAVYYSLIQGFCTHDDLVKAKELVSEMMTKGIPRPNIVFFNSVIARLCKEGRVKDAHGIFDLAMNIGERPNVITFNSLIHGYSLVGKMAKAFGVLDDMESVGIEPDVVTYTTLRHGYSRNRR

SEQ ID NO: 1209 - protein, 300 aa, Triticum aestivum; identical to SEQ ID NO: 1208

SEQ ID NO: 1210 - protein, 300 aa, Triticum aestivum; identical to SEQ ID NO: 1208

SEQ ID NO: 1211 - protein, 300 aa, Triticum aestivum; identical to SEQ ID NO: 1208

SEQ ID NO: 1212 - protein, 300 aa, Triticum aestivum; identical to SEQ ID NO: 1208

SEQ ID NO: 1213 - protein, 300 aa, Triticum aestivum; identical to SEQ ID NO: 1208

SEQ ID NO: 1214 - protein, 297 aa, Triticum aestivum
MMVEDGGSCQPSVVFYNIIVYVLLKEGAMGKAYNLFCEMLQTGISPDVVTYNSIIYGMCKVHAMDMAEEVLQQMFDRGILPNYRTYNSLIHGYYSLGQCGEVDQVLREMFGNGVQPNVVTYSVQTDYLCKSGRCTEARKIFDSMTGLGQKPTVTNYNILLHGYAMERSFHDMHCLIDLMVENGIVPHHHIYHILIFACSKEKMVDEAMHIFKKMRQQGLNPNAASYGTVINLLCNIGRMDDMMLQFNQMITEGLAPDIIVFNTLLIGFCSCGKWEKVYELFSEMLNRGIYPVMCSSR

SEQ ID NO: 1215 - protein, 288 aa, Triticum aestivum
MMDEAMLIFSGMCGQGVTPESRMARLADALNKFSQMISTDIQPNTVVYHSLIQGFCAYGDSVKAKELVYEMINNGFPRPNIVFFSSIINSLCKEGKVIDAQDIFNLVVEIGESPDVTIFTSLIEGFCLVGKMEKASQVFDSMVSVGIEPNIVTYGTLVDGYCRSGRIDDGLILFRDLLHKGVKPTTITYYIILDGLFLAGRTVAAKKMFHEMIGSGTPVSLHTYDIILGGLCRNNCADEAITLFQKLVAMNVKLDITIHNTMINAMFKVQRREKANDFCCSISQWIGT

SEQ ID NO: 1216 - protein, 244 aa, Triticum aestivum
MMDEAMLIFSGMCGQGVTPESRMARLADASNKFSQMISTDIQPNTVVYHSLIQGFCAYGDSVKAKELVYEMINNGFPRPNIVFFSSIINSLCKEGKVIDAQDIFNLVVEIGESTDVTIFTSLIKGYCLVGKMEKASRVFDSMVSVGIEPNIVTYGTLVDGYCRSGRIDDGLILFRDLLHKGVKPTTITYYIILDGLFHAGRIVAAKKMFHEMIGSGTPVSLHTYDIILGGLCRNNCADEAITLF

SEQ ID NO: 1217 - protein, 288 aa, Triticum aestivum; identical to SEQ ID NO: 1215

SEQ ID NO: 1218 - protein, 288 aa, Triticum aestivum; identical to SEQ ID NO: 1215

SEQ ID NO: 1219 - protein, 244 aa, Triticum aestivum; identical to SEQ ID NO: 1216

SEQ ID NO: 1220 - protein, 288 aa, Triticum aestivum; identical to SEQ ID NO: 1215

SEQ ID NO: 1221 - protein, 292 aa, Triticum aestivum
MSRLHPRYFSSSVSSLADELLSEFQHHLGSGTLSPQLAHQLFDGLLRQPVPVSARALNGLFAALARTPPSTTCADGPARAIDLFNRMARAGRRRRVIAPTSHTYSILIECCCLARRPDLGPSFFAHLLKTGVTADVVIFSGLFKCLCDMKRTEEALDVLLHRVPHDLPNVISYSVIVKSLCDNGRSQLALDLLHIMAKKGADHSPNVVSYNMVIDGFFKEGETSKACDLLQEMIQQGVVPDVVMYSSIIDALCKARAMDKAEVVLRQMVHDGDVTAARSFDESGDNYRFGGF

SEQ ID NO: 1222 - protein, 234 aa, Triticum aestivum
MDKAELILRHMVHSGVQPHDRIYNTLIHGFLTLGQQKEAFRLLELMTSQGVMPNVVTCNSVMDYLCKHGRVKEAAEIFYSMVVKGQKPNVISYSVMLHGYAKEGSLVAMIDLCELMARDGVVPDRSFFNILIKAYAKYGMIDVAMLFFDEMLKQGVNPNDITYLTLISAFCKMGRMDDAMIKFNEMIDMGIPHDTTVYMCMIEGYLNHGDSVKAKEFITKMKSRDVCHSPRKGN

SEQ ID NO: 1223 - protein, 280 aa, Triticum aestivum
MVMDGFFKEGEVSKACDLFHEMIQQGVVPTEVTYSSIINALCKARAMDKAELILRHMVHSGVQPHDRIYNTLIHGFLTSGQQKEAFRLLKLMTSQGVMPNVVTCNSVMDYLCKHGRVKEAAEIFYSMVVKGQKPNVISYSVMLHGYAKEGSLVAMIDLCELMARDGVVPDRSFFNILIKAYAKYGMIDVAMLFFDEMLKQGVNPNDITYLTLISAFCKMGRMDDAMIKFNEMIDMGIPHDTTVYMCMIEGYLNHGDSVKAKEFITKMKSRDVSHSPRKGN

SEQ ID NO: 1224 - protein, 234 aa, Triticum aestivum; identical to SEQ ID NO: 1222

SEQ ID NO: 1225 - protein, 234 aa, Triticum aestivum; identical to SEQ ID NO: 1222

SEQ ID NO: 1226 - protein, 280 aa, Triticum aestivum; identical to SEQ ID NO: 1223

SEQ ID NO: 1227 - protein, 234 aa, Triticum aestivum; identical to SEQ ID NO: 1222

SEQ ID NO: 1228 - protein, 226 aa, Triticum aestivum
MPPSPLPQSVSAGTLSPKHVHHLFDKLLRQATPVPERSLNGFLAALAHAPDSSACKDGPALVLAIFNRVSREEAGLRVATPAICTYCILMDCCCRARRRDLGLAFFGRLMRTGLKTNQIAANNLLKCLCHAKRTDEAVSVLLHRMSDLGCAPNCISYNTVLKSLCEDSRSQQALDLLQMMAKEGGVCSPSLVKYNTVIHGFFKEGQVSKACNLYHEMMSKGLCLMW

SEQ ID NO: 1229 - protein, 263 aa, Triticum aestivum
MPRRLYSTRPMSYTRLCRRLSSSSTTTSSSSPSWCPHAAFATATERVRAGTLSPEHVHHLFDKLLRQATPVPERSLNGFLAALAHAPDSSACKDGPALVLAIFNRVSREEAGLRVATPAICTYCILMDCCCRARRRDLGLAFFGRLVRTGLKTNQIAANNLLKCLCHAKRTDEAVSVLLHRMSDLGCAPNCILYNTVLKSLCEDSRSQQALDLLQMMAKEGGVCSPSLVKYNTVIHGFFKEGQVSKACNLYHEMMSKGLCLMW

SEQ ID NO: 1230 - protein, 263 aa, Triticum aestivum; identical to SEQ ID NO: 1229

SEQ ID NO: 1231 - protein, 226 aa, Triticum aestivum; identical to SEQ ID NO: 1228

SEQ ID NO: 1232 - protein, 226 aa, Triticum aestivum; identical to SEQ ID NO: 1228

SEQ ID NO: 1233 - protein, 184 aa, Triticum aestivum
MSRVCLCRRLSSTSTSNTPPSPSWSPQAAFAAATERARAGTLSPQDAHHLFDELFRQATPVPERSLDGFLAALGRAASSEACRDGPSLALTLFNRLCREEAGRRVAPPTIYTYGILMNCCCRVRRPDLGLAFFGRLLRTGLKTNEVVASTLLKCLCCAKRADEAVNVLLHRMSVAVCLIPSHTT

SEQ ID NO: 1234 - protein, 280 aa, Triticum aestivum
MIHGYSTLGRWKETGKMFREMTSRGIIPDVVSWTSFMTSLCKHGRSREATGIIDYMSAKGHKPNIVSYSILFHGYATEGCFDDMINLLDSMATNGIVPNRQIFSILVDAYAKRGMMDEAMLIFTGMWEQGVIPDVSRWGQGVSPESTIFRLADALNKFSQMISIDIKPDTVVYHSLIQGFCTHGDLVKAKELVYEMINKYIPPPTVVFFSSIINSLCKEGRVTDAQDIFNLVVEIGESPDVFAFTSLLDRYCLVGKMEKASQVLMQWYQLALSLMHPPKA

SEQ ID NO: 1235 - protein, 280 aa, Triticum aestivum; identical to SEQ ID NO: 1234

SEQ ID NO: 1236 - protein, 280 aa, Triticum aestivum; identical to SEQ ID NO: 1234

SEQ ID NO: 1237 - protein, 280 aa, Triticum aestivum; identical to SEQ ID NO: 1234

SEQ ID NO: 1238 - protein, 262 aa, Triticum aestivum
MLRPELAHQLFDEMLRQPVPVSARALSGLFAALARAPPSPVCTDSPALAIDLFNLMARAGRRQATTPTIYTYIILMECCHRACRPDLGIAFFGRLLKTGIPTNIITYSSLFKCLCDMKRTEEALNVLLHKMPDDLPNVISYSVILKSFCDNGRIQLALDLLQMMAKKGADHSPDVMSYNMVIDGFFKEGEVSKACNLFQEMIRQGIVPTEVTYSSIINALCKARAMDKAEVVLRSMVHNGAQPDVVTYNSLIQGYSTLGQLK

SEQ ID NO: 1239 - protein, 249 aa, Triticum aestivum
MLRQPVPVSARALSGLFAALARAPPSPVCTDSPALAIDLFNCMARAGRRQATAPTIYTYIILMECCHRACRPDLGLAFFGRLLKTGIPTNIITYNSLFKCLCDMKRTEEALNVLLHKMPDDLPNVISYSVILKSFCDNGRIQLALDLLQMMAKKGADHSPDVMSYNMVIDGFFNEGEVSKACNLFQEMIRQGIVPTEVTYSSIINALCKARAMDKAEVVLRSMVHNGAQPDVVTYNSLIQGYSTLGQLK

SEQ ID NO: 1240 - protein, 262 aa, Triticum aestivum; identical to SEQ ID NO: 1238

SEQ ID NO: 1241 - protein, 262 aa, Triticum aestivum; identical to SEQ ID NO: 1238

SEQ ID NO: 1242 - protein, 249 aa, Triticum aestivum; identical to SEQ ID NO: 1239

SEQ ID NO: 1243 - protein, 262 aa, Triticum aestivum; identical to SEQ ID NO: 1238

SEQ ID NO: 1244 - protein, 279 aa, Triticum aestivum
MDCCCRACRPDLALAFFGRLFRTGLEANQVIFCTLLKGLCHAKRTDEALDVLLHRMPELGCTPDVVAYNTVIHGFFREGQVGKACDLFHGMAQQGVMPDVVTYSSVIDALCKARAMDKAEYFLRQMIGNGVVPNNVAYNSLIHGYSSSGHWKEAVRVFKEMTSRRVTADVHTYNMFMTFLCKHGRSKEAAGIFDTMAMKGLKPDNVSYAILLHGYATEGCLVDMINLFNSMERDCILLDCCIFSILINAYAKSGKLDKAMLLFKEMQKQGVNLHSHIQP

SEQ ID NO: 1245 - protein, 279 aa, Triticum aestivum; identical to SEQ ID NO: 1244

SEQ ID NO: 1246 - protein, 279 aa, Triticum aestivum; identical to SEQ ID NO: 1244

SEQ ID NO: 1247 - protein, 279 aa, Triticum aestivum; identical to SEQ ID NO: 1244

SEQ ID NO: 1248 - protein, 279 aa, Triticum aestivum; identical to SEQ ID NO: 1244

SEQ ID NO: 1249 - protein, 279 aa, Triticum aestivum; identical to SEQ ID NO: 1244

SEQ ID NO: 1250 - protein, 274 aa, Triticum aestivum
MKQRGFVPDVGTYNSIIDAMCKARAMDKAKLVLRQMVDSGVRPDIVTYNKLIHGYSISGQFEEVVTLLEKMRSQGVKPTVFTCNTVMDYLCKHGRIKEAAEFFYSMVEKGHKPNIVSYAIMLHGYAKEGSLVEMTDLCELMARDGIVSYLHCFNILINAYAKCGMMDVAILFFKDMLKQGVNPDEVTYLAVIAGYCRVGMMDDAMEKFNEMIGMGVPHNATVYRCMIQGYLNHGDFLKAKELITEMKTKGIHPRLSKSQGIDPGYLMSQLFPGA

SEQ ID NO: 1251 - protein, 274 aa, Triticum aestivum; identical to SEQ ID NO: 1250

SEQ ID NO: 1252 - protein, 274 aa, Triticum aestivum; identical to SEQ ID NO: 1250

SEQ ID NO: 1253 - protein, 274 aa, Triticum aestivum; identical to SEQ ID NO: 1250

SEQ ID NO: 1254 - protein, 274 aa, Triticum aestivum; identical to SEQ ID NO: 1250

SEQ ID NO: 1255 - protein, 274 aa, Triticum aestivum; identical to SEQ ID NO: 1250

SEQ ID NO: 1256 - protein, 283 aa, Triticum aestivum
MPCARSGQWTRQSWSFSRWLIMVFDQICIHAWNSFMYSLCKNGGSKEAAEFFDSMTSKGLKPNIVVYSTLLHGYATEGCLADMINLFNSMKDNAIVANCNVFNILIDAYAKRGMMHEAMLIFTEMQEQRVSPNVFTYAIVTAALCRMGRLSDAMDKLNEMIAMGLQPNKVVYHSLIQGFCTHGDLVKAKALVSEMMNKGIPRPNIVFFSSVINSLCKEGRVTEAHDIFDLAINIGERPNVITFSSLIDGYCLAGKMDKAFGVLDANTFEYFKENMCKRISRWK

SEQ ID NO: 1257 - protein, 283 aa, Triticum aestivum; identical to SEQ ID NO: 1256

SEQ ID NO: 1258 - protein, 283 aa, Triticum aestivum; identical to SEQ ID NO: 1256

SEQ ID NO: 1259 - protein, 283 aa, Triticum aestivum; identical to SEQ ID NO: 1256

SEQ ID NO: 1260 - protein, 283 aa, Triticum aestivum; identical to SEQ ID NO: 1256

SEQ ID NO: 1261 - protein, 283 aa, Triticum aestivum
MPCARSGQWTRQSWSFSRWLIMVFDQICIHAWNSFMYPLCKNGGSKEAAEFFDSMTSKGLKPNIVVYSTLLHGYATEGCLADMINLFNSMKDNAIVANCNVFNILIDAYAKRGMMHEAMLIFTEMQEQRVSPNVFTYAIVTAALCRMGRLSDAMDKLNEMIAMGLQPNKVVYHSLIQGFCTHGDLVKAKALVSEMMNKGIPRPNIVFFSSVINSLCKEGRVTEAHDIFDLAINIGERPNVITFSSLIDGYCLAGKMDKAFGILDANTFEYFKENMCKRISRWK

SEQ ID NO: 1262 - protein, 283 aa, Triticum aestivum; identical to SEQ ID NO: 1256

SEQ ID NO: 1263 - protein, 254 aa, Triticum aestivum
  misc_feature (4)..(4): Xaa can be any naturally occurring amino acid
  misc_feature (33)..(34): Xaa can be any naturally occurring amino acid
  misc_feature (38)..(39): Xaa can be any naturally occurring amino acid
  misc_feature (42)..(46): Xaa can be any naturally occurring amino acid
MVSXGLRPDSFSYDTLLNGYCKAGRIDNACCLXXEMLXXGVXXXXXTYNTILNGLFRSGRFSEARELYVNMIKSRKLWSICTYSIILDGFCKNNCFDEAFKIFQSLCSMDLQLDIITFNIMIDGLFKGGRKEDAMDLFATISAYGLVPDVVTYRLIAENLIEEGSLGEFDGLFSAMEKSGTAPNSHMLNALVRRLLHRGDISRAGVYLYKLDEKNFSLEASTTSMLISLYSRGEYQPHAKSLPEKYRFLIEANS

SEQ ID NO: 1264 - protein, 186 aa, Triticum aestivum
MPRIPLCNSTMPMSRIGLRRRRLSSSFSTSTSTARSSRSWSPHAAFAAATERVRAGTLSPEDAHHLFDQLLRQDTPVQERSLGGFLAALARAPDSASCRDGPSLALSLFNRVCREEAGRRVAPPTAYTYAILMNCCCRVRRPDLGLALFGRLLRTGLKTNEIVANTLLKCLLLRKTDRRGCQRAAS

SEQ ID NO: 1265 - protein, 186 aa, Triticum aestivum; identical to SEQ ID NO: 1264

SEQ ID NO: 1266 - protein, 223 aa, Triticum aestivum
MPRIPLCNSTMPMSRIGLRRRRLSSSFSTSTSTARSSRSWSPHAAFAAATERVRAGTLSPEDAHHLFDQLLRQDTPVQERSLGGFLAALARAPDSASCRDGPSLALSLFNRVCREEAGRRVAPPTAYTYAILMNCCCRVRRPDLGLALFGRLLRTGLKTNEIVANTLLKCLCCAKRTDEAVSVLLHRMSKLSLVVCLMPSHTTQFLRAYVIIAAASGRSTSFR

SEQ ID NO: 1267 - protein, 223 aa, Triticum aestivum; identical to SEQ ID NO: 1266

SEQ ID NO: 1268 - protein, 186 aa, Triticum aestivum; identical to SEQ ID NO: 1264

SEQ ID NO: 1269 - protein, 186 aa, Triticum aestivum; identical to SEQ ID NO: 1264

SEQ ID NO: 1270 - protein, 226 aa, Triticum aestivum; identical to SEQ ID NO: 1228

SEQ ID NO: 1271 - protein, 137 aa, Triticum aestivum
MPRRSWPAGGAAHNLHLRRPHELMRPHSSALGLVFFGRLLRRGLKTNTIVFSSLLKCLCHAKRTDEAVSVLLHRMSELGCVPDAFSYTIVLKSLCDGSSSQRALDLLQMMEKGEGVCSPLAWCYIPRSSTASLRKGK

SEQ ID NO: 1272 - protein, 137 aa, Triticum aestivum; identical to SEQ ID NO: 1271

SEQ ID NO: 1273 - protein, 255 aa, Triticum aestivum
MLDRGICPDTVFFNTIMDRLCKNERVMEAQDLFDLMVHMGVKPDVCTYNTLIGGYLFVGKMDEVSKLLDNMVSIGMEPDVITYNILIDGYSKNGKIDDALVVFRGILERKDKPSVITFNIMIGALLKCRRKEEAKDLFDGIWAKGLVPDVVTYSLMIQKLIEEGSLQESDDLFLSMEKNGYPANSCMLNAIVRRLLQKGEMPRAGTYLSKIDERNFTLEASTTSLLTALASVGKCQEYKGLLPEKYHCFLEQGTD

SEQ ID NO: 1274 - protein, 255 aa, Triticum aestivum; identical to SEQ ID NO: 1273

SEQ ID NO: 1275 - protein, 255 aa, Triticum aestivum; identical to SEQ ID NO: 1273

SEQ ID NO: 1276 - protein, 255 aa, Triticum aestivum; identical to SEQ ID NO: 1273

SEQ ID NO: 1277 - protein, 255 aa, Triticum aestivum; identical to SEQ ID NO: 1273

SEQ ID NO: 1278 - protein, 255 aa, Triticum aestivum; identical to SEQ ID NO: 1273

SEQ ID NO: 1279 - protein, 260 aa, Triticum aestivum
MNYFLRCWIAAFVPTVFFNTIMDRLCKNERVMEAQDLFDLMVHMGVKPDVCNYNTLIGGYLFDGKMDEVRKLLDNMVSIGLKPDVITYTILIDGYSKNGRIDDALVVSREMLAGNVKPCVITLNIMIGALLKGGRKEEAKDLFDGIWAKGLVPTVVTYSLMIQKLIEEGSLQESDDLFLSMEKNGCAADSHMLNAIVRSLLRKGEVPRAGTYLSKIDERRFTLEASTASLLAAVASGGKGQEYKELLPEKYHYFLEQGTD

SEQ ID NO: 1280 - protein, 260 aa, Triticum aestivum; identical to SEQ ID NO: 1279

SEQ ID NO: 1281 - protein, 260 aa, Triticum aestivum; identical to SEQ ID NO: 1279

SEQ ID NO: 1282 - protein, 260 aa, Triticum aestivum; identical to SEQ ID NO: 1279

SEQ ID NO: 1283 - protein, 260 aa, Triticum aestivum; identical to SEQ ID NO: 1279

SEQ ID NO: 1284 - protein, 260 aa, Triticum aestivum; identical to SEQ ID NO: 1279

SEQ ID NO: 1285 - protein, 227 aa, Triticum aestivum
MSDLGCVPNCISHGIVLKSLCEDSRSQQALDLLRMMAKEGGACSPSLVTYNTVIHGFFKEGQVSKACNLYHEMMQQGVVPDVVTYNSIIDALCKARAMGKAELFLRQMVDNGVRPDNVTYTAVIHGYSTLGQWKKAAKMFREMTSLGLVPNTVTWNSSMASLCKHGRSKEAAEIFHSMAAKGHKPDVVSYRVLLQGYATEGALQIWLISIIQCQAMVLYPIARFSTY

SEQ ID NO: 1286 - protein, 227 aa, Triticum aestivum; identical to SEQ ID NO: 1285

SEQ ID NO: 1287 - protein, 272 aa, Triticum aestivum
MSCVYLKNFPAAHVQHRHQNGRTTDPRSICHFPDQARPPHPRRLTRRRRRRRRRSSSSTSTYPQPPGVQLPPPPPQLLLSHPAHVTMFRMRLRNSSTMPMSRIGLLLRRLSSSSSSSYFSTSTSPPSRSRSWSPRDAFAAATERVRAGTLSPEDAHHLFDQLLRQDTPVHERSLGGFLAALARAPDSAACRDGPALAIALFNRVCREEAGRPVVPPTVYTYAILMNCCCRVRRPDLGLALFGRLLRTGLKQMRSSPAPSSSASAAQNGQMKQ

SEQ ID NO: 1288 - protein, 272 aa, Triticum aestivum
MSCVYLKNFPAAHVQHRHQNGRTTDPRSICHFPDQARPPHPRRLTRRRRRRHRRSSSSTSTYPQPPGVQLPPPPPQLLLSHPAHVTMFRMRLRNSSTMPMSRIGLLLRRLSSSSSSSYFSTSTSPPSRSRSWSPRDAFAAATERVRAGTLSPEDAHHLFNQLLRQDTPVHERSLGGFLAALARAPDSAACRDGPALAIALFNRVCREEAGRPVVPPTVYTYAILMNCCCRVRRPDLGLALFGRLLRTGLKQMRSSPAPSSSASAAQNGQMKQ

SEQ ID NO: 1289 - protein, 272 aa, Triticum aestivum; identical to SEQ ID NO: 1288

SEQ ID NO: 1290 - protein, 272 aa, Triticum aestivum
MSCVYLKNFPAAHVQHRHQNGRTTDPRSICHFPDQARPPHPRRLTRRRRRRHRRSSSSTSTYPQPPGVQLPPPPPQLLLSHPAHVTMFRMRLRNSSTMPMSRIGLLLRRLSSSSSSSYFSTSTSPPSRSRSWSPRDAFAAATERVRAGTLSPEDAHHLFDQLLRQDTPVHERSLGGFLAALARAPDSAACRDGPALAIALFNRVCREEAGRPVVPPTVYTYAILMNCCCRVRRPDLGLALFGRLLRTGLKQMRSSPAPSSSASAAQNGQMKQ

SEQ ID NO: 1291 - protein, 272 aa, Triticum aestivum; identical to SEQ ID NO: 1287

SEQ ID NO: 1292 - protein, 272 aa, Triticum aestivum; identical to SEQ ID NO: 1288

SEQ ID NO: 1293 - protein, 188 aa, Triticum aestivum
MLHEMVECGTTVSLSTYNIILGGLCRNDCTDEAIVLFQKLGAMNVKLDITTLNTMIDAMYKVRRRQEAKDLFAAISASGLVPNSPTYGTMIQSLQKEGLMEEADNIFSSMEKSGCVLSSRLLNDIIRTLLEKGEILKAGNYMSKIDGKNAQLEASTSSLLLSLFSGEGESREQIQLLPVKYQFFDAVS

SEQ ID NO: 1294 - protein, 188 aa, Triticum aestivum
MLHEMVECGTTVSLSTYNIILGGLCRNDCTDEAIVLFQKLGAMNMKLDITTLNTMIDAMYKVRRRQEAKDLFAAISASGLVPNSPTYGTMIQSLLKEGLMEEADNIFSSMEKSGCVLSSRLLNDIIRTLLEKGEILKAGNYMSKIDGKNAQLEASTSSLLLSLFSGEGKYREQIQLLPVKYQFFDAVS

SEQ ID NO: 1295 - protein, 188 aa, Triticum aestivum; identical to SEQ ID NO: 1293

SEQ ID NO: 1296 - protein, 188 aa, Triticum aestivum; identical to SEQ ID NO: 1293

SEQ ID NO: 1297 - protein, 188 aa, Triticum aestivum; identical to SEQ ID NO: 1293

SEQ ID NO: 1298 - protein, 188 aa, Triticum aestivum; identical to SEQ ID NO: 1293

SEQ ID NO: 1299 - protein, 188 aa, Triticum aestivum; identical to SEQ ID NO: 1293

SEQ ID NO: 1300 - protein, 222 aa, Triticum aestivum
MSELGCVPDAFSYTIVLKILCDASSSQWALDLLQTMEKGGGVCSPDVVSYTTVIHNLLKEGEVSKACNLYHEMVQQGVVPDVRTYSSIINALCKAEAMDKAELFLRQMVDKGVRPNNKTYTSIIHGYSTLGRWKEAGKMFREMTSQGIIPDVVTWTSFMASFCKHGRSREAAKIFDYMSSRGHKPNVVSYSILFHGYGIEGCFADMINLLNSMANNGIVPNR

SEQ ID NO: 1301 - protein, 222 aa, Triticum aestivum
MSELGCVPDAFSYTIVLKILCDASSSQWALDLLQTMEKGGGVCSPDVVSYTTVIHNLLKEGEVSKACNLYHEMVQQGVVPDVRTYSSIINALCKAEAMDKAELFLRQMVDKGVRPNNKTYTSIIHGYSTLGRWKEAGKMFREMTSQGIIPDVVTWTSFMASFCKHGRSREAAKNFDYMSSRGHKPNVVSYSILFHGYGIEGCFADMINLLNSMANNGIVPNR

SEQ ID NO: 1302 - protein, 222 aa, Triticum aestivum; identical to SEQ ID NO: 1300

SEQ ID NO: 1303 - protein, 222 aa, Triticum aestivum
MSELGCVPDAFSYTIVLKIICDACSSQWALDLVQTMEKGGGVCSPDVVSYTTVIHDLLKEGEVSKACNLYHEMVQQGVVPDVRTYSSIINALCKAEAMDKAELFLCQMVDNGVRPNNKTYTSIIHGYSTLGRWKEAGKMFREMTSQGIIPDVVTWTSFMASFCKHGRSREAAKIFDYMSSRGHKPNVVSYSILFHGYGTEGCFADMINLLNSMANNGIVPNR

SEQ ID NO: 1304 - protein, 222 aa, Triticum aestivum; identical to SEQ ID NO: 1303

SEQ ID NO: 1305 - protein, 222 aa, Triticum aestivum; identical to SEQ ID NO: 1300

SEQ ID NO: 1306 - protein, 172 aa, Triticum aestivum
MDCCCRARRPELGLALFVRVLRKGLKTNQIVANTFLKCLCYAKRTDEAVNVLLHRMSELGCVPDAFSYNIVLKIFCDNSMSQRGLELLQMMAKEGGGCFPDMVAYNTVIHGLFKEGEIGKACNLFHEMVQQGVVPGVVTYSSIIDALCKARAMDKAELVLRQMVANGAQPNQ

SEQ ID NO: 1307 - protein, 172 aa, Triticum aestivum; identical to SEQ ID NO: 1306

SEQ ID NO: 1308 - protein, 172 aa, Triticum aestivum; identical to SEQ ID NO: 1306

SEQ ID NO: 1309 - protein, 172 aa, Triticum aestivum; identical to SEQ ID NO: 1306

SEQ ID NO: 1310 - protein, 189 aa, Triticum aestivum
MRSQGVMPNVVTCNSVMTYHCKNGRVKEAAEIFYSMAVNGRKPDVISYSIMLHGHATEGSIVEMIDLCELMARDGVVPNRSVFNILIKAYAKYGMMDVAMLFFEDMLKKGVNPNEVTYLTVISAFCKMGRMDDAMEKFNEMIDMGVPLDTEVYMCMVEGYFNHDDSMKAEEFITKMKSRDIFHRPRKGN

SEQ ID NO: 1311 - protein, 189 aa, Triticum aestivum; identical to SEQ ID NO: 1310

SEQ ID NO: 1312 - protein, 189 aa, Triticum aestivum; identical to SEQ ID NO: 1310

SEQ ID NO: 1313 - protein, 189 aa, Triticum aestivum; identical to SEQ ID NO: 1310

SEQ ID NO: 1314 - protein, 189 aa, Triticum aestivum; identical to SEQ ID NO: 1310

SEQ ID NO: 1315 - protein, 189 aa, Triticum aestivum; identical to SEQ ID NO: 1310

SEQ ID NO: 1316 - protein, 253 aa, Triticum aestivum
MSRRVVPVGRRILEQNIKARYHARDIGTEDALHLFDELLPYAGRSSIHAINCLLTVVGRDCPALGASLFNRVARSKVAPSSITYAILVDCCCRAGRQDLGHTAMGQVIKMGFLADAMITFSHLLKAICAENKTSYAMDILLRIMPMFNCVPDVISYNILFKGDCNEKRSQEALELIQVMVEHGGGCQPTVVSYSTVIDGLLKEGEVNKAYSLFCQMLQRGISPDVVTCSSIISGMCKLHAMDKAEEVLQQMLD

SEQ ID NO: 1317 - protein, 253 aa, Triticum aestivum; identical to SEQ ID NO: 1316

SEQ ID NO: 1318 - protein, 253 aa, Triticum aestivum; identical to SEQ ID NO: 1316

SEQ ID NO: 1319 - protein, 209 aa, Triticum aestivum
MDCCCRVRRPKLVLTLFSLFLMKGLKTNQIIVNTFLKCLCYAKRTDEAVNVLLHRMAELVCVPNAFSYNIVLKSFCDYSMSQRALELLQMIAKEGGGCFPDVVAYNTVIHGLFMEGETGKACNLFHEMVQQDVAPSVVTYISIIDALCKARAMEKAELVLWQMVANGAHPDTMTYSCMINGYSTSGRLKEATKLLREMTGRGLIPDIVT

SEQ ID NO: 1320 - protein, 259 aa, Triticum aestivum
MDCCCRVRRPKLVITLFSLFLMKGLKTNQIIVNTFLKCLCYAKRTDKAVNVLLHRMSELGCVPNAFSYNIVLKSSCDYSMSQRALELLQMIAEEGGGCFPDVVAYNTVIHGLFMEGETGKACNLFHEMVQQDVAPSVVTYISIIDALCKARAMEKTELVLWQMVANGAHPDTMTYSCMINGYSTSGRLKEATKLLREMTGRGLIPDIVTCNSFLASLCKLGRSKEAAEFFESMTAKGHKTGYRLIPHFASWVCYRRMLC

SEQ ID NO: 1321 - protein, 254 aa, Triticum aestivum
MDCCCRVRRPKLVLTLFSLFLMKGLKTNQIIVNTFLKCLCYAKRTDKAVNVLLHRMSELGCVPNAFSYNIVLKSFCDYSMSQRALELLQMIAKEGGGCFPDVVAYNTVIHGLFMEGETGKACNLFHEMVQQDVAPSVVTYISIIDALCKARAMEKAELVLWQMVANGAHPDTMTYSCKINGYSTFGRLKEATKLLREMTGRGLIPDIVTCNSFLASLCKLGRSKEAAEFFESMTAKGHKTGYRLIPHFASWVCY

SEQ ID NO: 1322 - protein, 254 aa, Triticum aestivum
MDCCCRVRRPKLVLTLFSLFLMKGLKTNQIIVNTFLKCLCYAKRTDKAVNVLLHRMSELGCVPNAFSYNIVLKSFCDYSMSQRALELLQMIAKEGGGCFPDVVAYNTVIHGLFMEGETGKACNLFHEMVQQDVAPSVVTYISIIDALCKARAMEKAELVLWQMVANGAHPDTMTYSCMINGYSTSGRLKEATKLLREMTGRGLIPDIVTCNSFLASLCKLGRSKEAAEFFESMTAKGHKTGYRLIPHFASWVCY

SEQ ID NO: 1323 - protein, 259 aa, Triticum aestivum; identical to SEQ ID NO: 1320

SEQ ID NO: 1324 - protein, 254 aa, Triticum aestivum; identical to SEQ ID NO: 1322

SEQ ID NO: 1325 - protein, 179 aa, Triticum aestivum
MDCCCRARRPDLGLAFFGRLLRTGLRTDGIDAYALIRCFCLAKRTDKAVSVLLHRMPELGCAPDALSYSVVLKVLCDDGRSQRALDLPQMMSKEGGGCAPNVVAYSTVIHGFCKEGEVSKACDLFNEMEHQGVKPNVVTYTSIIDALCKARAMDKAESFLRQMVDNDVRPNNVAYKCMI

SEQ ID NO: 1326 - protein, 179 aa, Triticum aestivum; identical to SEQ ID NO: 1325

SEQ ID NO: 1327 - protein, 179 aa, Triticum aestivum; identical to SEQ ID NO: 1325

SEQ ID NO: 1328 - protein, 179 aa, Triticum aestivum; identical to SEQ ID NO: 1325

SEQ ID NO: 1329 - protein, 179 aa, Triticum aestivum; identical to SEQ ID NO: 1325

SEQ ID NO: 1330 - protein, 179 aa, Triticum aestivum; identical to SEQ ID NO: 1325

SEQ ID NO: 1331 - protein, 179 aa, Triticum aestivum; identical to SEQ ID NO: 1325

SEQ ID NO: 1332 - protein, 243 aa, Triticum aestivum
MSSLRVLRRSSTSTSTSTSPPSRSWSPTAAFAAATERVRAGTLSQDDAHHLFDELLRQVTPVPERPLNGFLAALARATSSAACIRDGPALDVALFNRVCREQAGPRVAPLTVHTYNILMDCCCRASRPDLGLAFFARLLRTGLKTDEITANTFLKCLCYAKRTDEAVNVLLHRMSELGCVPNAFSYSIVLKSLCDNSMSQRALDLLQMMAKEGGACSPNVVAYSTVIHGFLGRRNRQGMQSVP

SEQ ID NO: 1333 - protein, 243 aa, Triticum aestivum; identical to SEQ ID NO: 1332

SEQ ID NO: 1334 - protein, 243 aa, Triticum aestivum; identical to SEQ ID NO: 1332

SEQ ID NO: 1335 - protein, 243 aa, Triticum aestivum
MSSLRVLRRSSASTSTSTSPPSRSWSPTAAFAAATERVRAGTLSQDDAHHLFDELLRQVTPVPERPLNGFLAALARATSSAACIRDGPALDVALFNRVCREQAGPRVAPLTVHTYNILMDCCCRASRPDLGLAFFARLLRTGLKTDEITANTFLKCLCYAKRTDEAVNVLLHRMSELGCVPNAFSYSIVLKSLCDNSMSQRALDLLQMMAKEGGACSPNVVAYSTVIHGFLGRRNRQGMQSVP

SEQ ID NO: 1336 - protein, 243 aa, Triticum aestivum; identical to SEQ ID NO: 1335

SEQ ID NO: 1337 - protein, 243 aa, Triticum aestivum; identical to SEQ ID NO: 1332

SEQ ID NO: 1338 - protein, 133 aa, Triticum aestivum
MDCCCRARRPDLGLALFGRFLRTGLRTNEIVATTFLKCLCCAKQIDEAVKVLLHRMPKLGCVPNAISYSIVLKSLCENSMSQQALDLLQMVGKEGGCLRDVMAYNTIIHGFFKEGGIDKARGYADCGDIQHSN

SEQ ID NO: 1339 - protein, 228 aa, Triticum aestivum
MPRLCSTTPMARLRRRRRYSSSTSSPSRRWDPRAAFAAATERIRAGTLRPEDAHHLFDELLLQANPVPERSLSDFLAALARAPSSAALRDGPSLALGLFNLVCREEAGPQVAPPTTCTYNILMDSCCRARRPDLGLAFFGRFLSTGLKANQIVATTLLKCLCHARRTDEAINVLLHRMSEFGCVPNVISYSIVLKSLCDDSRSQQALDLLQMVRKGGAAPSVWWHIAQ

SEQ ID NO: 1340 - protein, 228 aa, Triticum aestivum; identical to SEQ ID NO: 1339

SEQ ID NO: 1341 - protein, 228 aa, Triticum aestivum; identical to SEQ ID NO: 1339

SEQ ID NO: 1342 - protein, 228 aa, Triticum aestivum; identical to SEQ ID NO: 1339

SEQ ID NO: 1343 - protein, 228 aa, Triticum aestivum; identical to SEQ ID NO: 1339

SEQ ID NO: 1344 - protein, 228 aa, Triticum aestivum; identical to SEQ ID NO: 1339

SEQ ID NO: 1345 - protein, 246 aa, Triticum aestivum
  misc_feature (92)..(92): Xaa can be any naturally occurring amino acid
  misc_feature (95)..(95): Xaa can be any naturally occurring amino acid
  misc_feature (97)..(97): Xaa can be any naturally occurring amino acid
  misc_feature (102)..(102): Xaa can be any naturally occurring amino acid
  misc_feature (114)..(114): Xaa can be any naturally occurring amino acid
  misc_feature (119)..(119): Xaa can be any naturally occurring amino acid
  misc_feature (161)..(161): Xaa can be any naturally occurring amino acid
MIDKGVKPDNLTYTIIIDGLCKAQSVDRAEGVFQQMIDKGVKPNNGTYNCLIHGYLSTGQWEEVVQRIKEMSAHDLEPDVFTYGLLLDYLCXNGXCXEARSXFDSMIRKGIKPXVTIYXIMLHGYGTKGALSEMHDLLNLMVANGISPNHRIFNTMIYAYXKEAMIDEAMHIFIKMKQQGLSPDAVSYAELIDALCKLGRVDDAVLQFKQMINEGVTPDNVVFNSLVYGLCTVDKWEKVENYFSKC

SEQ ID NO: 1346 - protein, 253 aa, Triticum aestivum
MSRRFVPVDRRILERNIKARYHAGDIGTEDALNLFDELIQVAGPSSVLAINCLLTVVGRDCPALGVSLFNRVARAKVPPHNITYGILVDCCCRAGRLDLGHAGMGHVIKLGFAAEAIVNFSHLLKAICAEEKTSYAMEIVLRIMPEFNCIPNIFSYSILLKGLCNEKRSQEALELIHMMIDHGGSCQPNVVSYSTVLDGLLKDGEVGKAYSLFCVMLQRGISPNVVTCNSIISGMCKVHAMDKAEEVLQQMTD

SEQ ID NO: 1347 - protein, 253 aa, Triticum aestivum; identical to SEQ ID NO: 1346

SEQ ID NO: 1348 - protein, 253 aa, Triticum aestivum; identical to SEQ ID NO: 1346

SEQ ID NO: 1349 - protein, 205 aa, Triticum aestivum
MSRRFVPVDRRILERNIKARYHAGDIGTEDALNLFDELIQVAGPSSVLAINCLLTVVGRDCPALGVSLFNRVARAKVPPHNITYGILVDCCCRAGRLDLGHAGMGHVIKLGFAAEAIVNFSHLLKAICAEKKTSYAMDIVLRIMPEFNCIPNIFSYSILLKGLCNEKRSQEALELIHMMIDHGGSCQPNVVSYSTVLDGLLKEGE

SEQ ID NO: 1350 - protein, 205 aa, Triticum aestivum
MSRRFVPVDRRILERNIKARYHAGDIGTEDALNLFDELIQVAGPSSVLAINCLLTVVGRDCPALGVSLFNRVARAKVPPHNITYGILVDCCCCAGRLDLGHAGMGHVIKLGFAAEAIVNFSHLLKAICAEKKTSYAMDIVLRIMPEFNCIPNIFSYSILLKGLCNEKRSQEALELIHMMIDHGGSCQPNVVSYSTVLDGLLKEGE

SEQ ID NO: 1351 - protein, 241 aa, Triticum aestivum
MSSLRLLRRSSTSTSTSPPSRSWSPTAAFAAATERVRAGTLSQDDAHHLFDELLRQATPVPERPLNGFLAALARATSSAACITDGPALAVALFNRVCREQSGPRVVPLTVCTYNILMDCCCRTSRTDLGLAFFARLLRTGLKTDEITANTFLKCLCYAKRTDEAVNVLLHRMSELGCVPNAFSYSIVLKSLCNNNMSQRALDLLQMMAKDRGSCFPDVVAYSSHPWLFQGRRNKQGMQSVP

SEQ ID NO: 1352 - protein, 264 aa, Triticum aestivum
MSRLQVRSFSSSVSSRANELLNELHDHLGFGTLRPELAHQLFDEMLHQPVTVSVRALDDLFAALARVPASPACTDGPALAIDLFNRMARAGRRQVLAPSIYTYNILIECCHRACRPDLGPAFFGRLLKTGIKTDVVTYSSLLKCLCDMKRTEEALGVLLHRMPDDLPNVISYSVILKSFCDSGRSQLALDLLRMMAEKGSDHSPSMVLYSLVIDGFLKEGEISKACNLLPEMMQQGVVPDVVTYNSFIDALCKARAMDKAEVVL

SEQ ID NO: 1353 - protein, 264 aa, Triticum aestivum
MSRLQVRSFSSSVSSRANELLNELHGHLGFGTLRPELAHQLFDEMLHQPITVSVRALDDLFAALARAPASPACTDGPALAIDLFNRMARAGRRQVLAPSIYTYNILIECCHRACRPDLGPAFFGRLLKTGIKTDVVTYISLLKCLCDMKRTEEALGVLLHRMPDDLPNVISYSVILKSFCDSGRSQLALDLLRMMAEKGSDHSPSVVLYSLVIDGFLKEGEISKACNLLPEMMQQGVVPDVVTYNSFIDTLCKAREMDKAEVVL

SEQ ID NO: 1354 - protein, 264 aa, Triticum aestivum
MSRLQVRSFSSSVSSRANELLNKLHDHLGFGTLRPELAHQLFDEMLHQPVTVSVRALDDLFAALARVPASPACTDGPALAIDLFNRMARAGRRQVLAPSIYTYNILIECCHRACRPDLGPAFFGRLLKTGIKTDVVTYSSLLKCLCDMKRTEEALGVLLHRMPDDLPNVISYSVILKSFCDSGRSQLALDLLRMMAEKGSDHSPSMVLYSLVIDGFLKEGEISKACNLLPEMMQQGVVPDVVTYNSFIDALCKARAMDKAEVVL

SEQ ID NO: 1355 - protein, 264 aa, Triticum aestivum
MSRLQVCSFSSSVSSRANELLNELHDHLGFGTLRPELAHQLFDEMLHQPVTVSVCALDDLFAALARVPASPACTDGHALAIDLFNRMARAGRRQVLAPSIYTYNILIECCHRACRPDLGPAFFGRLLKTGIKTDVVTYSSLLKCLCDMKRTEEALGVLLHRMPDDLPNVISYSVILKSFCDSGRSQLALDLLRMMAEKGSDHSPSVVLYSLVIDGFLKEGEISKACNLLPEMMQQGVVPDVVTYNSFIDALCKARAMDKAEVVL

SEQ ID NO: 1356 - protein, 264 aa, Triticum aestivum; identical to SEQ ID NO: 1354

SEQ ID NO: 1357 - protein, 264 aa, Triticum aestivum; identical to SEQ ID NO: 1352

SEQ ID NO: 1358 - protein, 264 aa, Triticum aestivum; identical to SEQ ID NO: 1354

SEQ ID NO: 1359 - protein, 177 aa, Triticum aestivum
MAQQGVKPNVVTYNSVIDALCKAKAMDKAEVVLRQMIDHSVGPNSVTYSSLIHGYSSSGHWKEAVRVFKEMTSRRVTADVHTYNMFMTFLCKNGKSKDAAEIFNSMATKGLKPTTVSYAILLHGYATEGCLVDMTNFFNSMERDCILPDCCIFSILINAYAKSGKLDKAMLLHTAIW

SEQ ID NO: 1360 - protein, 215 aa, Triticum aestivum
MSHVRLHLHRRLLSSTSPPSRSWSPRDAFAVTTERLRAGTLCRDDAHNLFDELFRQAIPVPDRSLNGFLAALARATSSGACIRDGPALFNRVCREQAGSQVAPLTVHTYNILMDCCCRACRPDLGLALFGCILRTGLKIEQITANTLLKCLCYAKRTEEAVYVLLHRMSELGCVPDAFSCSIVLKSLCDNSMSQRGLDLLQMMAKGGGCSLNVGI

SEQ ID NO: 1361 - protein, 215 aa, Triticum aestivum
MSHVRLHLHRRLLSSTSPPSRSWSPRDAFAATTERLRAGTLCRDDAHNLFDELFRQAIPVPDRSLNGFLAALARATSSGACIRDGPALFNRVCREQAGSQVAPLTVHTYNILMDCCCRARRPDLGLALFGCILRTGLKIEQITANTLLKCLCYAKRTEEAVYVLLHRMSELGCVPDAFSCSIVLKSLCDNSMSQRGLDLLQMMAKGGGCSLNVGI

SEQ ID NO: 1362 - protein, 215 aa, Triticum aestivum; identical to SEQ ID NO: 1361

SEQ ID NO: 1363 - protein, 215 aa, Triticum aestivum; identical to SEQ ID NO: 1361

SEQ ID NO: 1364 - protein, 215 aa, Triticum aestivum; identical to SEQ ID NO: 1361

SEQ ID NO: 1365 - protein, 215 aa, Triticum aestivum
MSHVRLHLHRRLLSSTSPPSRSWSPRDAFAATTERLRAGTLCRDDAHNLFDELFRQAIPVPDRSLNGFLAALARATSSGACIRDGPALFNRVCREQAGSQVAPLTVHTYNILMDCCCRARRPDLGLALFGCILRTGLKIEQITANTLLKCLCYAKRTEEAVYVLLHRMSELGCVPDAFSCSIVLKSLCDNGMSQRGLDLLQMMAKGGGCSLNVGI

SEQ ID NO: 1366 - protein, 249 aa, Triticum aestivum
MPRVRPGSSSSTVSSRANQLLNKLKDHLDSGTLQPERAHQLFDKLLRQTVPVSASALNGLFAALARALPSAACTDGPALAIALFNRMAREGRRVIAPNIYTYSILIDCCCRSRRPDLGPAFFGFLLKTGIKADIITFTSLFKCLCHMKRIDEAVGVLLHRMPGDMPDAISYSIILKSFCNEGRSQRALDLLRMMAKKGANHSPEACTIVICGLIKEGELSKACSLFHEMMQQGVVPSVVAYSSIIDGLC

SEQ ID NO: 1367 - protein, 224 aa, Triticum aestivum
MEKALRVLDDMASAGIEPNVVTYGTLVDGYCRSGRIDDGLMLFREMLHKRVEPTTVTYNIILNGLFHAGRTVAAKMFHEMIKSGITVSISTYMIIHGGLCRNSHADEAITLFQKLGAMDVKLDVTILNTMINAMFKVQRREEANDLFAAISASGLVPNASTYGKNIQNLLEEGSLEEADDMFSSMEKSGCAPSSCLLNFIIRTLLKKGEIVKAGNYLYSYKKHT

SEQ ID NO: 1368 - protein, 224 aa, Triticum aestivum; identical to SEQ ID NO: 1367

SEQ ID NO: 1369 - protein, 224 aa, Triticum aestivum; identical to SEQ ID NO: 1367

SEQ ID NO: 1370 - protein, 224 aa, Triticum aestivum; identical to SEQ ID NO: 1367

SEQ ID NO: 1371 - protein, 249 aa, Triticum aestivum
MSRRYTITLISRLRVPRRCSSSTSISPPSRSWSPRDAFAAATERVRAGTLSPEDAHNLFDELLRQGTPVPERSLNGFLAALARATSSTACIKDGPALALALFNRVCREEASPQVAVPTVCTYSVLMDCCCRARRPDLGLALFGCILRKGLKIDQITANTLLKCLCYAKQTEEAVYVLLHRMSELSCVPDAFAYNIVLKSLCKGSRSQRAHDLLRTMAKDRGGCFPDVVTYTTVIHGFFKEGETGMQSIP

SEQ ID NO: 1372 - protein, 222 aa, Triticum aestivum
MLCKGLKPTTFNYNVILDGLFLAGQTVAAKEKFHEMVESGVTVCIDTYSIVLGGLCRNSCSSEAITLFQKLSAMNVKFDITIVNIIIGAFYRVERNQEAKDLFAAIPANGLVPNVVTYTIMMTNLIKEGSVEEADNLFLSMEKSGCTANSCLLNHIIRRLLEKGEIVKAGNYMSKVDAKSYSLEAKTVSQLISLFSRKGKYREHIKLLPTKYQFLEEAATVE

SEQ ID NO: 1373 - protein, 178 aa, Triticum aestivum
MPHLRLRRFSTAPMFHLLHCSSSSTSTSPPSRSWSPHAAFAAATERVRAGTLSPEDVHHLFDELLRQATPVPRRSLNGFLSTLARAPASAACIRASQQVAPLTVHTYGILMGCFCGARRPDLGLALFGRFLRTGLKTNEIIATTFLKCLCSAKRTDECRCQNRRISGRGSRTVRLGGW

SEQ ID NO: 1374 - protein, 198 aa, Triticum aestivum
  misc_feature (35)..(35): Xaa can be any naturally occurring amino acid
  misc_feature (37)..(37): Xaa can be any naturally occurring amino acid
MHSNEALDLLLHRMPELDCAPDVFSFNIVINGCFXEXEVDKACNLFHEMPQLGVQPDVVTYTSIMDALSKSGAMDKAEVLLRQMVDQGIEPNIRTYSCLIHGYSTFGQWKEALRVFKEMASLGVRPNSVTLNSFIDSLCKHRKTKKARDIFDSMAAKGHKPDIFSYSTMLNWYAKEGCFDDMTDLFNSMVRNGIVRNG

SEQ ID NO: 1375 - protein, 153 aa, Triticum aestivum
MRQRAAERTPLHGHLGFGTLRPDLAHQLFDEMLRQPVPVSVRALNGLFAALARAPPSTICTDAPALAIDLFNRMAQAGRRQVPAPTIITYNILIGCCHRACRPDLGPAFFGRLLKTGIKTNVITYNSLLKCLCDMKRTEEALGAAPQDARRPA

SEQ ID NO: 1376 - protein, 153 aa, Triticum aestivum; identical to SEQ ID NO: 1375

SEQ ID NO: 1377 - protein, 153 aa, Triticum aestivum; identical to SEQ ID NO: 1375

SEQ ID NO: 1378 - protein, 153 aa, Triticum aestivum; identical to SEQ ID NO: 1375

SEQ ID NO: 1379 - protein, 244 aa, Triticum aestivum
MPRRIPLPMPRRICIWLRCSSPSSSCTYPDSGLRHPSCLTSTLSGLRLRRSFTTPMSNLRLFRRSSSSTSTPTSRSSRSWSPHAAFAAATERVRAGTMNQDYAHNLFDELLRQATPVPGRSLNGFLAALARATSSAACIRNGPALTVALFNRVCREQAGLRVAPLTVHTYNILMDCCCRASRPDLGLALFGRFLRTGLKTNEIVASTLLKCLCYTKRTDEALNVLLHRMSELGCCLMPSHTTLF

SEQ ID NO: 1380 - protein, 244 aa, Triticum aestivum; identical to SEQ ID NO: 1379

SEQ ID NO: 1381 - protein, 244 aa, Triticum aestivum
MPRRIPLPMPRRICIWLRCSSPSSSCTYPDSGLRHPSCLTSTLSGLRLRRSFTTPMSNLRLFRRSSSSTSTPTSRSSRSWSPHAAFAAATERVRAGTMNQDYAHNLFDELLRQATPVPGRSLNGFLAALARATSSAACIRNGPALTVALFNRVCREQAGLRVAPLTVHTYNILMDCCCRASRPDLGLALFGRFLRTGLKTNEIVASTLLKCLCYAKRTDEALNVLLHRMSELGCCLMPSHTTLF

SEQ ID NO: 1382 - protein, 244 aa, Triticum aestivum; identical to SEQ ID NO: 1379

SEQ ID NO: 1383 - protein, 244 aa, Triticum aestivum; identical to SEQ ID NO: 1379

SEQ ID NO: 1384 - protein, 244 aa, Triticum aestivum; identical to SEQ ID NO: 1379

SEQ ID NO: 1385 - protein, 252 aa, Triticum aestivum
MRVTYSSIINALCKARAMDKAEVILRHMVHNGVQPHDRIYNTLIHGFLTLGQLKEAFRLLKVMRSQGSMPNGVTCTSVMDYLCKHGRIKEAEEIFYSMAVNGRKPDIVSYSIMLHGYAIEGSLVQMIDLCELMARDGVVPNLRCFNILINAYAKYGRMDVAMLFFEDMLKQGVKPNEFTYLTVISAFCKMGRMDDAMEKFSEMIDMGVPLETEVYMCMVEGYFNHGDSMKAEEFITKMKNRDIHHKPWKGNR

SEQ ID NO: 1386 - protein, 243 aa, Triticum aestivum
MMQQGVEPSVWTYSSIIDALCKARAMDKAELVLQQMVNKGVQPNNVTYNCMIHGYSTSGRWKEAAKLFREMKSRGLIPDTFTCNALMTYLCKHGRSKEAAEISDAMTAKGHKPDIVSYSILLHGYANEGCFADMIDLFNSMERNGIAADCHVFSILIGAYAKCELMDEAMLKFTQMRRQGVSPDAFTYSTVIVALCRVGRLADAIGKFGEMIAMGVQPDRPVYRSLIQGCFMHGGLVKATAGF

SEQ ID NO: 1387 - protein, 243 aa, Triticum aestivum; identical to SEQ ID NO: 1386

SEQ ID NO: 1388 - protein, 243 aa, Triticum aestivum; identical to SEQ ID NO: 1386

SEQ ID NO: 1389 - protein, 243 aa, Triticum aestivum; identical to SEQ ID NO: 1386

SEQ ID NO: 1390 - protein, 243 aa, Triticum aestivum; identical to SEQ ID NO: 1386

SEQ ID NO: 1391 - protein, 243 aa, Triticum aestivum; identical to SEQ ID NO: 1386

SEQ ID NO: 1392 - protein, 225 aa, Triticum aestivum
MVHNGVQPDVVTYNSLIQRFLTSGQLKEAIRLLKLMTSQGIMPDVVTCNSVMTYHCKNGRVKEAAEIFYSMAVKGRKPNVISYSIMLHGYAIQGPLVEMIDLCELMARDGVVPNLHCFNILINAYAKYGRMDVAMLFFEDMLKQGVKPNEFTYLTMMSAFCKMGRMDDVMEKLSEMIDMGVPVDTEVCMCMVEGYFNHGDSMKAKEFITRMKNMDIHHKPRKGNR

SEQ ID NO: 1393 - protein, 225 aa, Triticum aestivum; identical to SEQ ID NO: 1392

SEQ ID NO: 1394 - protein, 225 aa, Triticum aestivum; identical to SEQ ID NO: 1392

SEQ ID NO: 1395 - protein, 225 aa, Triticum aestivum; identical to SEQ ID NO: 1392

SEQ ID NO: 1396 - protein, 225 aa, Triticum aestivum; identical to SEQ ID NO: 1392

SEQ ID NO: 1397 - protein, 217 aa, Triticum aestivum
MEKALRVLDDMASAGIEPNVVTYGTLVDGYCRSGRIDDGLMLFREMLHKRVEPTTVTYNIILNGLFHAGRTVAAKMFHEMIKSGITVSISTYRIIHGGFCRNSHADEAITLFQKLGAMDVKLDVTILNTMINAMFKVQRREEANDLFAAISASGLVPNASTYGKNIQNLLEGGSLEEADDMFSSMEKSGCAPSSCLLNQNVIGKGGDSQGWKLSLLI

SEQ ID NO: 1398 - protein, 217 aa, Triticum aestivum; identical to SEQ ID NO: 1397

SEQ ID NO: 1399 - protein, 243 aa, Triticum aestivum
MSRRLVPVGSRLLERNIEHRYRSRNIGTEDALNLFGELIQDPGPTSVRAINGLLTVVGRDCPALGISLFNRVARAKVPPHNITYGILVDCCCRAGRLDLGHAAMGHVIKLGFAAEAIVNFSHLLKAICAEKKTSYAMDIVLRIMPMFNCIPNIFSYSILFKGLCNEKRSQEALELIHLMVEDGGSCQPNVVSYTTVVDGLLKEGEVGKAYSLFCEMLQRGISPDDVTYNSIISGMCKVHAMEG

SEQ ID NO: 1400 - protein, 246 aa, Triticum aestivum
MEKGGVCSPDVVSYTTVIHGLLKEGEVSKACSLFDEMVQQGVVPNVVTYSSIIDALCKAGAMDKTELVLWQMVDSGIQPDNVTYTSMIHGYSTLGRWKEAGKMFREMTSRGIIPDVVTWTSFMTSLCKHGRSREATGIIDYMSAKCHKPNIVLYSILFHGYATEGCFDDMINLLDSMANNAIVPNRQVFSILVDAYAKRGMMDEAMPIFTGMCEQGVIRDVYRWGQGVSPESTVGRLADALNKFVR

SEQ ID NO: 1401 - protein, 246 aa, Triticum aestivum; identical to SEQ ID NO: 1400

SEQ ID NO: 1402 - protein, 246 aa, Triticum aestivum; identical to SEQ ID NO: 1400

SEQ ID NO: 1403 - protein, 246 aa, Triticum aestivum; identical to SEQ ID NO: 1400

SEQ ID NO: 1404 - protein, 246 aa, Triticum aestivum
MEKGGVCSPDVVSYTTVIHGLLKEGEVSKACSLFDEMVQQGVVPNVVTYSSIIDALCKAGAMDKTELVLWQMVDSGIQPDNVTYTSMIHGYSTLGRWKEAGKMFREMTSRGIIPDVVTWTSFMTSLCKHGRSREATGIIDYMSAKCHKPNIVLYSILFHGYATEGCFDDMINLLDSMANNAIVPNRQVFSILVDAYAKRGMMDEAMPIFTGMCEQGVIPDVYRWGQGVSPESTVGRLADALNKFVR

SEQ ID NO: 1405 - protein, 246 aa, Triticum aestivum; identical to SEQ ID NO: 1404

SEQ ID NO: 1406 - protein, 225 aa, Triticum aestivum
MSRRLVPVGRRILEQSIKDRYYSAGIGTEDALQLFDELLPDAEPSLIRAINCLLTVIGRDCPALGVSHFNRVARANVAPNSITYTILVDCCCRAGRLDLGFAAMGHIIKMGFTAEAIFTFNHLLKAICAEKKTSYAMDIVLRIMPELNCTPNVFSYNILFKGLCNEKRSQEALELINIMVEDGGSCRPDVVTYNTVIGGLLKEGVVDKAYSLFCEMLKGRFCQML

SEQ ID NO: 1407 - protein, 225 aa, Triticum aestivum; identical to SEQ ID NO: 1406

SEQ ID NO: 1408 - protein, 225 aa, Triticum aestivum; identical to SEQ ID NO: 1406

SEQ ID NO: 1409 - protein, 225 aa, Triticum aestivum; identical to SEQ ID NO: 1406

SEQ ID NO: 1410 - protein, 225 aa, Triticum aestivum; identical to SEQ ID NO: 1406

SEQ ID NO: 1411 - protein, 225 aa, Triticum aestivum; identical to SEQ ID NO: 1406

SEQ ID NO: 1412 - protein, 222 aa, Triticum aestivum
MTNRSVTPDVCTYNLLMTSLYKNGNSKEAAQLFYSMATKGLKPDTVSYAILLHGYATEGCLVDMINLFNSMATDCILPNCHIFNILIYAYAKSGKLDKAMLIFKDMQKQGVSPDAVTYSTVIHAFCKKGRLDDAVIKFNQMIDTGVRPEASAYRSLIQGFCTHGDLVKAKEYVTEMMKKGMLPPDIMFFSSIMQKLCTEGREIIYRKLMQRATHLKLKLFRC

SEQ ID NO: 1413 - protein, 239 aa, Triticum aestivum
MVHSGVRPDTVTYTSLIHGYSTLGQFEEVVRLLEEMRSLGVKPNVFTCNTVMDYLWKHGRIKEAAEFFYSMAEKGHKPNIVSYAIMLHGYAKEGSLVEMSDLCELMARDGIVPDLRCFNILINAYAKCGMMDVAILFFKDMLKQGVNPDEITYLAVIAGYCRVGMMDDAMENFNEMIGMGVPHNATVYRCMIQGYLNHGDFLKAKELITEMKTKGIHPRPRKSQGIDPGYLMTQLFTGA

SEQ ID NO: 1414 - protein, 217 aa, Triticum aestivum
MSRIHLHRRLFSSTTRPLRSWSPRAAFAAVTERVRAGALSQDDAHHLFDELLRQATPVPGRSLDGFLAALVRAPASGACRDGPALALALFNRVCRDESGARVAPPTIFTYGILMNCCCRAHRPDLGLAFFARLLTTGLKADQIAANTFLKCLCYAKRTDEAVNVLLHRMSELGCVPNAFSYSIVLKSLCDNSMSQRALDLLQMMTRWRNDKSGSYTR

SEQ ID NO: 1415 - protein, 217 aa, Triticum aestivum
MSRIHLHRRLFSSTTRPLRSWSPRAAFAAVTERVRAGALSQDDAHHLFDELLRQATPVPGRSLNGFLAALVRAPASGACRDGPALALALFNRVCRDESGARVAPPTIFTYGILMNCCCRAHRPDLGLAFFARLLTTGLKADQIAANTFLKCLCYAKRTDEAVNVLLHRMSELGCVPNAFSYSIVLKSLCDNSMSQRALDLLQMMTRWRNDKSGSYTR

SEQ ID NO: 1416 - protein, 217 aa, Triticum aestivum; identical to SEQ ID NO: 1415

SEQ ID NO: 1417 - protein, 217 aa, Triticum aestivum; identical to SEQ ID NO: 1414

SEQ ID NO: 1418 - protein, 217 aa, Triticum aestivum; identical to SEQ ID NO: 1415

SEQ ID NO: 1419 - protein, 217 aa, Triticum aestivum; identical to SEQ ID NO: 1414

SEQ ID NO: 1420 - protein, 201 aa, Triticum aestivum
MTRLHSTMACACRVRIRCRRLSSSATSPSSRSWSPRAAFAASTERFRAGTLGRPDAHRLFDELLRRDTLVPSCSLNGLLPVLARATSSASCVTDGPALAVALFSRVLRAEAGPWVACPTVCTYGILMDCCYRVRRPDLGRASGRASRQTRSSPTTRSSASATPSGPTRPSACCFMGCPTSAVCLMPSHTTFRKRLSEDRRS

SEQ ID NO: 1421 - protein, 201 aa, Triticum aestivum; identical to SEQ ID NO: 1420

SEQ ID NO: 1422 - protein, 201 aa, Triticum aestivum; identical to SEQ ID NO: 1420

SEQ ID NO: 1423 - protein, 201 aa, Triticum aestivum; identical to SEQ ID NO: 1420

SEQ ID NO: 1424 - protein, 201 aa, Triticum aestivum; identical to SEQ ID NO: 1420

SEQ ID NO: 1425 - protein, 201 aa, Triticum aestivum; identical to SEQ ID NO: 1420

SEQ ID NO: 1426 - protein, 236 aa, Triticum aestivum
MDWPPSTGTTWKSTNRIDRLPLESSCSAFTTHTSKAMPRFSSTPPMSPPRLRVGLGAGHSSSTSHPSRIWDPHAAFAAATERARSGNLTPEDAHHLFDELLRQGNPVQERPLNNLLAALARAPASAACSDGPALAVNLFSRISQGARRRVAHPTACTYSILMDCCCRVHRLDLAFAFFARLLRTGLKANQVIFCTLLKGLCHAKRTDEALDVLLHRMPELGCTPNAVAYNPISVCI

SEQ ID NO: 1427 - protein, 236 aa, Triticum aestivum; identical to SEQ ID NO: 1426

SEQ ID NO: 1428 - protein, 243 aa, Triticum aestivum
MDYLCKSGRCGEARKLFDSMISLGQKPTVTTYNILLHGYAMERYFHDMHCLIDLMAENGISPDHYVYNILIFAYAKEKMVGEVMHIFTKMRQQGFNPDAASYGTGINLLCSIGRMDDAVLQFNQMVTEGLAPDIIVFTTLLSGFCSCGKWEKVHELFSEMLNRGIYPNAVFFNKIMSPLCKNGRVMAAQDLFDLMIHMGVKPDMHAYNTMMGGYMFVGKMDEVRKLLDNMVSTGLEPDIFTYG

SEQ ID NO: 1429 - protein, 243 aa, Triticum aestivum; identical to SEQ ID NO: 1428

SEQ ID NO: 1430 - protein, 239 aa, Triticum aestivum
MLLCMVYFLMITDGLSLFMEMSLSGVKPTTIMYNIILDGLFCSGRTVSAKEKFDTMIESGIPVGIDTYNIVLSGLCKNNCTDEAIELFKKLRAMNVKIDVITLNTMISAMFKTRRIEEAKDLFATISAIGLVPSVVTYILMITNFIKEGLLAEADDMFLAMEKAGCAPNSSLLNQVVRVLLEKGAAVQAATYLAKIDAKHLSLEASTVSLIISLFSRKGELWEHVKLLPVKYQPPEMFD

SEQ ID NO: 1431 - protein, 239 aa, Triticum aestivum; identical to SEQ ID NO: 1430

SEQ ID NO: 1432 - protein, 239 aa, Triticum aestivum; identical to SEQ ID NO: 1430

SEQ ID NO: 1433 - protein, 239 aa, Triticum aestivum; identical to SEQ ID NO: 1430

SEQ ID NO: 1434 - protein, 239 aa, Triticum aestivum; identical to SEQ ID NO: 1430

SEQ ID NO: 1435 - protein, 239 aa, Triticum aestivum; identical to SEQ ID NO: 1430

SEQ ID NO: 1436 - protein, 242 aa, Triticum aestivum
MMNRGIPHSNIPFFGSVIKNLCQEGRVMDAHEIFDLVIDMGERPDDILFNSLIVGYCLVGKMDKALKVLDVMESVGVEPDVITYNTLVNGYCKSGRIDDGFVLFREMPSKRVKPDTVTYGIILAGLFRAWRTVDARTMFHEMIESGITVDIVTYNIILTGLCRNNCIDEAIALFQKLGVMSVKFNIAILNTMIDAMYKVWRREEVSDLFAAISASTSRKTPISPGSLGPLVLVHEPGLMGRY

SEQ ID NO: 1437 - protein, 226 aa, Triticum aestivum
MGKAELFLRRMVDNSVQPDRVTYTSMIHGYSTLGRWKEATKMFREMTGRGLIPNIVTWNSFMASLCKHGRSKEAAEIFFSMAAKGNKPNIITYGILLHGYGNEGSFVDMMSLFNSMKGNGIVANRQVFNILIDAYAKRGLIDEAVLILTEMRGHGLSPDVLPKKGFPPLCIQSNQPNHTEIGVGAEAAQSRPKETTEKEQKKQMPTTADQQKRRSLAIAAPTGIFH

SEQ ID NO: 1438 - protein, 226 aa, Triticum aestivum; identical to SEQ ID NO: 1437

SEQ ID NO: 1439 - protein, 226 aa, Triticum aestivum; identical to SEQ ID NO: 1437

SEQ ID NO: 1440 - protein, 226 aa, Triticum aestivum; identical to SEQ ID NO: 1437

SEQ ID NO: 1441 - protein, 226 aa, Triticum aestivum; identical to SEQ ID NO: 1437

SEQ ID NO: 1442 - protein, 226 aa, Triticum aestivum
MGKAELFLRRMVDNSVQPDRVTYTSMIHGYSTLGRWKEATKMFREMTGRGLIPNIVTWNSFMAYLCKHGKSKEATEIFFSMAAKGNKPNIITYGILLHGYGNEESFVDMMSLFNSMKGNGIVANRQVFNILIDAYAKRGLIDEAVLILTEMRGHGLSPDVLPKKGFPPLCIQSNQPNHTEIGAGAEAAQSRPKETTEKEQKKQMPTTADQQKRRSLAIAAPTGIFH

SEQ ID NO: 1443 - protein, 185 aa, Triticum aestivum
MVESGTTVSISTYGIILGELCRNNCTEEAIILFHKLGAMNVKFDITIFNTMIDAMYKVRRREEANILFAAISANGLVPNASTYRIMITNLLKEGSMEEADHMFSSMETSGYAPSSVLLNAIIRMLLEKGEIVKAGNYLSKVDGKSISLEASTSLLMWHLFSTEGKYHEQIKSLPERYRFFGVRHS

SEQ ID NO: 1444 - protein, 185 aa, Triticum aestivum; identical to SEQ ID NO: 1443

SEQ ID NO: 1445 - protein, 185 aa, Triticum aestivum; identical to SEQ ID NO: 1443

SEQ ID NO: 1446 - protein, 185 aa, Triticum aestivum; identical to SEQ ID NO: 1443

SEQ ID NO: 1447 - protein, 185 aa, Triticum aestivum; identical to SEQ ID NO: 1443

SEQ ID NO: 1448 - protein, 185 aa, Triticum aestivum; identical to SEQ ID NO: 1443

SEQ ID NO: 1449 - protein, 185 aa, Triticum aestivum; identical to SEQ ID NO: 1443

SEQ ID NO: 1450 - protein, 221 aa, Triticum aestivum
MPRLRLRRFSTAPMFHLLRRSSSSTSTSPPSRSWSPHAAFAAATECVRAGTLSPEDAHHLFDELLRQATPVPERPLNGFLAALARAPASAACIRDGPALAVALFNRVCREEAGLQVAAPTVCTYNILMDCCCRAHRPDLGLAFFGRFLRTGLKTEQITVSTFLKCLCYAKRTEEAVNVLLHGMSELGCVPNAISYSIVLKSLCKNSMSQRALDLLFQCGGI

SEQ ID NO: 1451 - protein, 221 aa, Triticum aestivum; identical to SEQ ID NO: 1450

SEQ ID NO: 1452 - protein, 221 aa, Triticum aestivum; identical to SEQ ID NO: 1450

SEQ ID NO: 1453 - protein, 178 aa, Triticum aestivum
MDMALRIMPKFNCIPDVFSYNILFKGLCTEKRSQEALELIHVMAEDGGSCQPNVVSYSTVVDGLLKEGEVDKAYSLFCQMLKRRISPNVVTCSSIISVMCKVHAMDKAEQVLQQMFDTRILPNVATYTSLIQGYYSLGHCEEVDWIFKKMSRNGVQPNIVAYKHTDGLSLQERKMRIS

SEQ ID NO: 1454 - protein, 178 aa, Triticum aestivum; identical to SEQ ID NO: 1453

SEQ ID NO: 1455 - protein, 178 aa, Triticum aestivum; identical to SEQ ID NO: 1453

SEQ ID NO: 1456 - protein, 178 aa, Triticum aestivum; identical to SEQ ID NO: 1453

SEQ ID NO: 1457 - protein, 178 aa, Triticum aestivum; identical to SEQ ID NO: 1453

SEQ ID NO: 1458 - protein, 178 aa, Triticum aestivum; identical to SEQ ID NO: 1453

SEQ ID NO: 1459 - protein, 197 aa, Triticum aestivum
MTSTPMRRLLLCRRSSSSSTSTSPPSRPWSPHAAFAAATWTLTPKHAHHLFDELLRQDTPVPERSLDGFLAALTRASSSASCRDGPALALDLFSHLCREEAGPRVAPPTIFTYGVLMNCCCRTRRSQLGLAFFGRLLRTGLKTNTIVFSSLLKCLCHAKWADEAVSVLLHRMSELGCVPDAFSYTIVLKSLCDASSS

SEQ ID NO: 1460 - protein, 197 aa, Triticum aestivum; identical to SEQ ID NO: 1459

SEQ ID NO: 1461 - protein, 197 aa, Triticum aestivum; identical to SEQ ID NO: 1459

SEQ ID NO: 1462 - protein, 197 aa, Triticum aestivum
MTSTPMRRLLLCRRSSSSSTSTSPPSRPWSPHAAFAAATWTLTPKHAHHLFDELLRQDTPVPERSPDGFLADLTRASSSASCRDGPALALDLFSHLCREEAGPRVAPPTIFTYGVLMNCCCRTRRSQLGLAFFGRLLRTGLKTNTIVFSSLLKCLCHAKWTDEAVSVLLHRMSELGCVPDAFSYTIVLKSLCDASSS

SEQ ID NO: 1463 - protein, 197 aa, Triticum aestivum; identical to SEQ ID NO: 1459

SEQ ID NO: 1464 - protein, 197 aa, Triticum aestivum; identical to SEQ ID NO: 1462

SEQ ID NO: 1465 - protein, 221 aa, Triticum aestivum
MSLSGVKPTTIIYNIILDGLFCSGRTGSAKEKFHTMTESGIPVGVDTYNIVLSGLCRNNCTDEAIELFKKLRATNVKIDVMTLNIMISAMFKTRRIEEAKDLFATISAIGLVPSVVTYSVMMTNFIKEGSLAEADDMFLAMEKASCAPNSILLNQVVRALLEKGAVVKAATYLAKLDAKQLSVEASTISLIVSLFSGEGKLREHVELLPVKYQPPESSTDN

SEQ ID NO: 1466 - protein, 221 aa, Triticum aestivum; identical to SEQ ID NO: 1465

SEQ ID NO: 1467 - protein, 221 aa, Triticum aestivum; identical to SEQ ID NO: 1465

SEQ ID NO: 1468 - protein, 221 aa, Triticum aestivum; identical to SEQ ID NO: 1465

SEQ ID NO: 1469 - protein, 167 aa, Triticum aestivum
MYMFDFILGIGQRPDVIMYNSLMDGYCLVGKVEEAVRVLDAMKSAGLQPTTVTYGILLNGYCKIGRIAAGLSLFKEMSLSGVKPITIMYNIILDGLFCSGRTVCAKEKFHTMNESGIPVGVDTYNIVLSGLCKNNCTDEAIELFKELRAKNVKINVMILNTMIFCNV

SEQ ID NO: 1470 - protein, 167 aa, Triticum aestivum
MYMFDFILGIGQRPDVIMYNSLMDGYCLVGKVEEAVRVLDAMKSAGLQPTAVTYGILLNGYCKIGRIAAGLSLFKEMSLSGVKPTTIMYNIILDGLFCSGRTVCAKEKFHTMNESGIPVGVDTYNIVLSGLCKNNCTDEAIELFKELRAKNVKINVMILNTMIFCNV

SEQ ID NO: 1471 - protein, 167 aa, Triticum aestivum; identical to SEQ ID NO: 1470

SEQ ID NO: 1472 - protein, 167 aa, Triticum aestivum; identical to SEQ ID NO: 1470

SEQ ID NO: 1473 - protein, 167 aa, Triticum aestivum
MYMFDFILGIAQRPDVIMYNSLMDGYCLVGKVEEAVRVLDAMKSAGLQPTTVTYGILLNGYCKIGRIAAGLSLFKEMSLSGVKPITIMYNIILDGLFCSGRTVCAKEKFHTMNESGIPVGVDTYNIVLSGLCKNNCTDEAIELFKELRAKNVKINVMILNTMIFCNV

SEQ ID NO: 1474 - protein, 167 aa, Triticum aestivum; identical to SEQ ID NO: 1473

SEQ ID NO: 1475 - protein, 206 aa, Triticum aestivum
MTGRWDPHTLGCATPNSLRCVRTRRPFRTPPRRSLVSDSAIPFLLTSAPRRCPASAAPPPRRSPASTSSATSPPPPPPPPPRRQPHAPGHPMPPLPRPRSVSVPGHSGRKTHTTCSTNCFGRPSRSLNGFLAVLARVPASGVCIRDGPALAVSLFNRVCREEAGPQVARLTVCTYNILMDCCCRARRPELGLALFRRFLRKGLKTD

SEQ ID NO: 1476 - protein, 206 aa, Triticum aestivum; identical to SEQ ID NO: 1475

SEQ ID NO: 1477 - protein, 206 aa, Triticum aestivum; identical to SEQ ID NO: 1475

SEQ ID NO: 1478 - protein, 228 aa, Triticum aestivum
MVSIGEHACPPNSAFLLPNPNSCPGCAGAVGGERHRRPLGPLPLPDSSRSIGGAMSRRAVPAGRRILEQNIKSRYRAGAIGTDDALHLFDELLQVAWPSSIAAINCLLIVVGRDCPALAVSLFNHIARAKVAPHNITYGILVDCCSRAGRWTLASLPWATSLRRDLRQDPLSLSATCSGPSVRRRRPATEWTSCSELCLSLTAYRMFTPTTFFSRASATRREAKRLSS

SEQ ID NO: 1479 - protein, 228 aa, Triticum aestivum; identical to SEQ ID NO: 1478

SEQ ID NO: 1480 - protein, 228 aa, Triticum aestivum; identical to SEQ ID NO: 1478

SEQ ID NO: 1481 - protein, 220 aa, Triticum aestivum
MISTDIKPDTVVYHSLIQGFCTHGDLVKAKELVYEMINKDIPPPTIVLFSSIINSLCKEGRVTDAQDIFNLVIEIGESPDVFAFTSLLDGYCLVGKMEKASQVFDAMVSAGIEPNASTYSVMITNLLKQGLVEEAESMFSSMEKSGCAPDSPLMNDIIRILLEKGEIVKAGDYMSKVDGRSISLEATTTSLLKCLFSSKGKYREQINLLPVKYQFFNGAS

SEQ ID NO: 1482 - protein, 220 aa, Triticum aestivum; identical to SEQ ID NO: 1481

SEQ ID NO: 1483 - protein, 150 aa, Triticum aestivum
MGSGVLPVAHTGGGSGGGTSISLILSWLLCTLPHLYMYWPLTLGKAYLLTYPTIGTGVQPNTVVYHSLVQGLCTHGDLAKAEELVSEMMNKGIARPNKSLASSFLYHYSISGSIRRVGANPAYIRVSICQHISVCDNPAETIRCSCHPSF

SEQ ID NO: 1484 - protein, 150 aa, Triticum aestivum; identical to SEQ ID NO: 1483

SEQ ID NO: 1485 - protein, 150 aa, Triticum aestivum; identical to SEQ ID NO: 1483

SEQ ID NO: 1486 - protein, 224 aa, Triticum aestivum
MVHNGVQPDAVTYNSLIQGYSTLGQLKELVRLLKVMRSQGVLPDVVTYNSLMTCLCKNGRFKEAVEIFYSMAVKGQKPNVVSYSIMLHGYAIQGSLVEMIDLCELMARDGVVPDLHCFNILISAYAKYGRMDVAMLFFEDMLKKGLNPNEFIYLTVISAFCKMGRMDDALEKFNEMIDRGVPLDTKIYVCMIEGYLNHGESVKAEEFITKMKSRDIRHGPRKGN

SEQ ID NO: 1487 - protein, 205 aa, Triticum aestivum
MSRLRLRLPRGSSSSTTVIPRLRLLRRCSSSTSTSPPSRSWSPRDAFAAATQRVRAGTLRPEDAHNLFDELLRQATPVPERSLNGFLAALARAPVSGACIRDGSALAVSLFNRVCREEAGAQVAALTGCTYSILMDCCCRARRPDLGLALFGRFLKKGLKTDQIVASTFLKCLCYAKRTDEAVNVVLHRMSELGCVPNALSTCSR

SEQ ID NO: 1488 - protein, 205 aa, Triticum aestivum; identical to SEQ ID NO: 1487

SEQ ID NO: 1489 - protein, 205 aa, Triticum aestivum; identical to SEQ ID NO: 1487

SEQ ID NO: 1490 - protein, 205 aa, Triticum aestivum; identical to SEQ ID NO: 1487

SEQ ID NO: 1491 - protein, 196 aa, Triticum aestivum
MFHQMIKSGITVPVSIYTIILRGLCKNNCAGEAITMFQELRAMNVKFDIITLNTMINAMYKVQRREEAKGLFAAISASGLMPDAYTYNVMINNLLKEGSVEEVDNMFSLMEKSGCAPSSHLVNDIIRRLLEKGEIAKAGNYLSKVDGKIISLEDSTISLLSSLFSSKGKYRENIKLLPANYHFLDGFSGIAHETNS

SEQ ID NO: 1492 - protein, 196 aa, Triticum aestivum; identical to SEQ ID NO: 1491

SEQ ID NO: 1493 - protein, 196 aa, Triticum aestivum; identical to SEQ ID NO: 1491

SEQ ID NO: 1494 - protein, 196 aa, Triticum aestivum; identical to SEQ ID NO: 1491

SEQ ID NO: 1495 - protein, 196 aa, Triticum aestivum; identical to SEQ ID NO: 1491

SEQ ID NO: 1496 - protein, 196 aa, Triticum aestivum; identical to SEQ ID NO: 1491

SEQ ID NO: 1497 - protein, 187 aa, Triticum aestivum
MVESGVSVCIDTYSIVLGGLCRNNCSGEAIMLFQKLSTMDVKFNIIIVNIMIDAFYKVQRNQEAKDLFAAVSANGLVANVFTYTIMMKNLIKEGSVEEADDLFLSMEKSGCTADSYMLNLIVRMLLEKGELVKAGNYMSKVDAKSYSLEAETVSLLISLFSGKGKYREHIGLLPTKYQFREEAAAVE

SEQ ID NO: 1498 - protein, 212 aa, Triticum aestivum
MSRRYTITLISRLRVPRRCSSSTSISPPSRSWSPRDAFAAATERVRAGTLSPEDAHNLFDELLRQGTPVPERSLNGFLAALTRATSSNACIKDGPALALALFTRGCREEAGPQVAVPTVWTYNILMDCCCRARRPDLGLALFGCILRTGLKIDQITANTLLKCLCYAKRTEEAVYVLLHSMSKLGCVPDAFAYNIVLKSLCVLGKQLVFPWP

SEQ ID NO: 1499 - protein, 212 aa, Triticum aestivum; identical to SEQ ID NO: 1498

SEQ ID NO: 1500 - protein, 212 aa, Triticum aestivum; identical to SEQ ID NO: 1498

SEQ ID NO: 1501 - protein, 212 aa, Triticum aestivum; identical to SEQ ID NO: 1498

SEQ ID NO: 1502 - protein, 211 aa, Triticum aestivum
MSRRYTITLISRLRVPRRCSSSTSISPPSRSWSPRDAFAAATERVRAGTLSPEDAHNLFDELLRQGTPVPERSLNGFLAALTRATSSNACIKDGPALALALFTRGCREEAGPQVAVPTVWTYNILMDCCCRARRPDLGLALFGCILRTGLKIDQITANTLLKCLCYAKRTEEAVYVLLHSMSKLGCVPDAFAYNIVLKSLCVLGKLVFPWP

SEQ ID NO: 1503 - protein, 211 aa, Triticum aestivum; identical to SEQ ID NO: 1502

SEQ ID NO: 1504 - protein, 223 aa, Triticum aestivum
MSRLQPRSFSSSASSRANELLDEFKYHLGSGTLWPELAHQLLDELQRQPVPVSARALNGLFAALADAPPSANCTDGPALAINLFNRHRISPDIYTYNILIECCHRACRPDLGPAFFGRLLKTGVTMSVITYSSYGESFGVDPLPSASSSSYGESFCSPGLGVDGTLVSCSFLKAAAGNSSWWRGCWWRGGFGLLLGAAPCFAGPADGFFGGAVLHPFIDGDGS

SEQ ID NO: 1505 - protein, 223 aa, Triticum aestivum; identical to SEQ ID NO: 1504

SEQ ID NO: 1506 - protein, 223 aa, Triticum aestivum; identical to SEQ ID NO: 1504

SEQ ID NO: 1507 - protein, 223 aa, Triticum aestivum
MSRLQPRSFSSSASSRANELLDEFKYHLGSGTLWPELAHQLLDELQRQPVPVSARALNGLFAALADAPPSANCTDGPALAINLFNRHRISPDIYTYNILIECCHRACRPDLGPAFFGRLLKTGVTMSVITYSSYGESFGVDPLPSASSSSYGESFCSPGLDVDGTLVSCSFLKAAAGNSSWWRGCWWRGGFGLLLGAAPCFAGPADGFFGGAVLHPFIDGDGS

SEQ ID NO: 1508 - protein, 89 aa, Triticum aestivum
MNCCCRVRRPDLGLAYFGRLLRTGLKTNEVVASTVLKCLCFAKRTDEAVDVLLHRTSVLGCVPNSFSYNIVLKSLCETAGASKRSACSR

SEQ ID NO: 1509 - protein, 220 aa, Triticum aestivum
MPRVRPGSSSGTVSSHANQLLNKLKDHVGSGTLQPERAHQLFDKLLRQAVPISACALNGLFAALARALPSAACTDGPALAIALFNRMAREGRWVIAPNMYTYTILIDCSCRSRRPDLGPAFFGRLLKTGITADVCTFSSLFKCLCDMKRIDEAVGVLLHRMPGDMPDVISYSTILKGFCNEGRSQLALDLLQMMVKKGAGQSPDVVSYNMVINGFFKEVK

SEQ ID NO: 1510 - protein, 220 aa, Triticum aestivum; identical to SEQ ID NO: 1509

SEQ ID NO: 1511 - protein, 220 aa, Triticum aestivum; identical to SEQ ID NO: 1509

SEQ ID NO: 1512 - protein, 220 aa, Triticum aestivum; identical to SEQ ID NO: 1509

SEQ ID NO: 1513 - protein, 220 aa, Triticum aestivum; identical to SEQ ID NO: 1509

SEQ ID NO: 1514 - protein, 220 aa, Triticum aestivum; identical to SEQ ID NO: 1509

SEQ ID NO: 1515 - protein, 196 aa, Triticum aestivum
MTRLYSTTACARRVRIRCCCRLSSTTSPPSRTWSPRAAFAVATEHVRAGTLSRPDAHRLFGELLRRDTPVPSRSLNGLLPVLARSTSSAYVPRHRWARPRRRPLQPHAPSGSRPACGASRSVHLLMDCCCRARRPDLGLAFLGRLLRTGLKTDQVVANNFLKCLCYAKRTDEDVDVLLHRMPDLGCVPNAVSCNIQ

SEQ ID NO: 1516 - protein, 209 aa, Triticum aestivum
MSRNGVEPTMITYNIQMDYLCKSGRCIEARKMFDSMVSLGQKPTVTTYNILLHGYAMERSFHDMNCLIELMDYNGIKPDHYGYNKLISSSAKKEMVGEVLHIFTKMRQQGLNPNVVNYGTVINLLSSIGRMDDAMSQFNQMITEGLAPDIIVSTPLLVVSVLVANGRRFMNYFLRCWIAASVQTQCSSTLLWITFAKMEGLWKPKMCST

SEQ ID NO: 1517 - protein, 209 aa, Triticum aestivum; identical to SEQ ID NO: 1516

SEQ ID NO: 1518 - protein, 209 aa, Triticum aestivum; identical to SEQ ID NO: 1516

SEQ ID NO: 1519 - protein, 208 aa, Triticum aestivum
MYKIILDGLFCSGRTVCAKEKFNTMTESGIPVGVDTYNIVLSGLCRNNCTDEAIELFKKLRATNVKIDVITFNTMISAMFKTRRIEEAKDLFATISAIGLVPSVVTYSVMMTNFIKEGLLAEADDMFLTMEKASCAPNSSLLNQVVRALLEKGAVVKAATYLAKLDAKQLSVEASTISLIVSLFSREGKLREHVELLPVKYQPPEMSV

SEQ ID NO: 1520 - protein, 214 aa, Triticum aestivum
MPRARPGSSSSSVSSRADQLLNKLKDHLGPRTLQPERAHQLFDKLLRQTVPVSAFALNGLFAVLARALPSAACTDGPALAIALFNRMNREGHQVIAPTNHAYNILIDCCCRSRFPGLGPAFFGRLLKTGIKANIITFHSLFKCQCDIKQMEEALNRLLYRIPELPDSISYSIIIKSLCDNGRSQCALDLLRMKAKKGADHYPEVVAYNRVEPMA

SEQ ID NO: 1521 - protein, 214 aa, Triticum aestivum
MPRARPGSSSSSVSSRADQLLNKLKDHLGPRTLQPERAHQLFDKLLRQTVPVSAFALNGLFAVLARALPSAACTDGPALAIALFNRMNREGHQVIAPTNHAYNILIDCCCRSRFPGLGPAFFGRLLKTGIKANIITFHSLFKCQCDIKQMEEALNRLLYRIPELPDSISYSIIIKSLCDNGRSQCALDLLRMKAKKGADHYPEVVAYNREEPMA

SEQ ID NO: 1522 - protein, 214 aa, Triticum aestivum; identical to SEQ ID NO: 1521

SEQ ID NO: 1523 - protein, 214 aa, Triticum aestivum; identical to SEQ ID NO: 1521

SEQ ID NO: 1524 - protein, 214 aa, Triticum aestivum; identical to SEQ ID NO: 1521

SEQ ID NO: 1525 - protein, 214 aa, Triticum aestivum; identical to SEQ ID NO: 1521

SEQ ID NO: 1526 - protein, 189 aa, Triticum aestivum
MSPLRLRPRLRPRLHARRSYSTSHPPRSQGWDPHAAFAAATERARSGNLTSKDAHHLFDQLLLQANPVNMRPPNDLLTALARAPASAACSNGPALAVALFSRLSQGARQRVVQPTACTHGILMDCCCRANRQDLALAFFGRLLRTGLKAGVIEVNTLLKGLCRAKRADEALDILLHRMPELGCTPDVVA

SEQ ID NO: 1527 - protein, 189 aa, Triticum aestivum; identical to SEQ ID NO: 1526

SEQ ID NO: 1528 - protein, 178 aa, Triticum aestivum
MIDTGVRQGTSVYGSLIQGFCTHGDLVKGKELVTEMMNKGIPPPDIKFFHSIMQNLCTEGRVIEARDILDLIAQIGMRPDVCTFNLLIGGYFLVRKIEHTSKIFDDMVSYGLKPCNITYGILINGYCKNGRIDHGLILFKDMLRKGLKPTTFNYSPSPLASPPWNSLNSKIFYILYLY

SEQ ID NO: 1529 - protein, 192 aa, Triticum aestivum
MDKAEVVLRQMVGNGVRPDIFTYTSLIHGYSISGQFEEVVRLLEKMRSQGVKPTVFTCNTVMDYLCKHGRIKEAAEFFYSMAEKGHKPNTVSYAIMLHGYAKEGSLVDMTNLCELMAGDGIIPNICIFNILISAYAKCGIMDVAMLFFEDMLKQGVNPDEVTYLAMIAGYCSMGSIVLVSLTCAKISEYNRS

SEQ ID NO: 1530 - protein, 192 aa, Triticum aestivum; identical to SEQ ID NO: 1529

SEQ ID NO: 1531 - protein, 192 aa, Triticum aestivum; identical to SEQ ID NO: 1529

SEQ ID NO: 1532 - protein, 192 aa, Triticum aestivum; identical to SEQ ID NO: 1529

SEQ ID NO: 1533 - protein, 192 aa, Triticum aestivum; identical to SEQ ID NO: 1529

SEQ ID NO: 1534 - protein, 192 aa, Triticum aestivum; identical to SEQ ID NO: 1529

SEQ ID NO: 1535 - protein, 185 aa, Triticum aestivum
MSPLRLRLRLHARHSSSASQPSRRQGWDPHAAFAAATECARSGNLTPEDAHHLFNELLRQGNPVLGRPLNNLLAALARAPASSACRDGPALAVALFSRISQGARLRVLHPTACTYGILMDCCCRANRQDLALAFFGRLLRTGLKAGVIEVNTLLKGLCRAKRADEALDILLHRMPELGCTPDVVA

SEQ ID NO: 1536 - protein, 185 aa, Triticum aestivum; identical to SEQ ID NO: 1535

SEQ ID NO: 1537 - protein, 185 aa, Triticum aestivum; identical to SEQ ID NO: 1535

SEQ ID NO: 1538 - protein, 185 aa, Triticum aestivum; identical to SEQ ID NO: 1535

SEQ ID NO: 1539 - protein, 202 aa, Triticum aestivum
MPRFSSSTPMSPARLRLLRLCARHSSSTSHPSRIWDPHAAFAAATQRARSGTLTTEDAHHLFDELLRQGNHVQERPLNNFLAALARAPASPFCSDGPALAVALFGRLSRGAGRRVAQPNVFTYGVLMDCCCRARRLDLAIAFFARLLKTGLEAGQVVFGTLLKGLCHAKRSDEALDVLLHRMPELGCIPTKYQFLEEAATVE

SEQ ID NO: 1540 - protein, 202 aa, Triticum aestivum; identical to SEQ ID NO: 1539

SEQ ID NO: 1541 - protein, 206 aa, Triticum aestivum
MTDLCELMARDGIVPYLHCFSILINAYAKCGMIDVAILFFKDMLKQGVNPDEVTYLAVIAGYCRVGMMDDAMEKFNEMIDMGVPHNATVYRCMIQGYLNHGDFLKAKELITEMKTKGIHPRCGKAKELIQGSSGSVDNIPVARGLHYTKISMMDKHCTSKTKTSKLFVGAMTPMTPPLDPPLTQGTSCHNSFTGACSRVVFIMVIT

SEQ ID NO: 1542 - protein, 206 aa, Triticum aestivum; identical to SEQ ID NO: 1541

SEQ ID NO: 1543 - protein, 206 aa, Triticum aestivum; identical to SEQ ID NO: 1541

SEQ ID NO: 1544 - protein, 206 aa, Triticum aestivum; identical to SEQ ID NO: 1541

SEQ ID NO: 1545 - protein, 206 aa, Triticum aestivum; identical to SEQ ID NO: 1541

SEQ ID NO: 1546 - protein, 206 aa, Triticum aestivum; identical to SEQ ID NO: 1541

SEQ ID NO: 1547 - protein, 187 aa, Triticum aestivum
MLDRSICPDRVFFNTDMDHLCKSGRVMEAQDIFDLMVHMGVKPFVRDYNTLIHGYCLVGKMDEGRKLLDNMCSIGLKPDDFTYSILIDGYSMKGRIDDALIVVREMLDGKVKPSIITINIMIGALLKGGRKEEAKDLFDGIWAKGLVPNVVTYSLMIQKLIEEGSLQESDDLFLLWRRMDVLPTPVH

SEQ ID NO: 1548 - protein, 187 aa, Triticum aestivum; identical to SEQ ID NO: 1547

SEQ ID NO: 1549 - protein, 161 aa, Triticum aestivum
MFQELGAMNVKFDIITLNTMINAMYKVQRREEAKGLFAAISASGLVPDAYTYNVMINNLLKEGSVEEVDNMFSLMEKSGCAPSSHLVNDITRRLLGKGEIAKAGNYLSKVDGKIISLEDSTTSLLSSLFSSKGKYRENIKLLPANYHVLDGFSRIAHENNS

SEQ ID NO: 1550 - protein, 161 aa, Triticum aestivum; identical to SEQ ID NO: 1549

SEQ ID NO: 1551 - protein, 211 aa, Triticum aestivum
MIMVFHQIIMATTYSYLLMLKKKMVDDVLHIFTKMRQQGLNPDVANYGAVINLLSSIGRMDDAMSQYNQMINEGLAPDIIVFNSLISGFYSCGKWEKVHELFSEMLDRGICPNTVFLNTIMDRLCKNERVMEAQDLFDLMVHMGVKPDVCTYSTLIGGYLFVGKMDEVSKLLDNMVSIGMEPDVITYNILMHLIYLIYIHLVCYVPWTYLI

SEQ ID NO: 1552 - protein, 158 aa, Triticum aestivum
MVDNGVRPDNVTYNSLIHGYSSSGHWKDMVRLFKEMKNRSVTPDVCTYNLLMNSLRKNGKTKDAAENFDSMAMKGLKPDTISYAIILHGYATEGCLVDMINLFNSMATDCILPDCDIFNILIDAYAKSGKLDKAMLMFKEMQKQGVSPELQMQSHIQP

SEQ ID NO: 1553 - protein, 208 aa, Triticum aestivum
MRYTVSSFIQLARQLFDEMLRQPVPISARALNGLFAALARAPPSTACTDGPALAVDLFNHMARAGRRWMTGPTVHTYNILIDCCHRACRPDLGPAFFGCLLKTGIIMSAITYSSLFKCLCDMRRTKEALNVLLHRMPDNLPNVISYSVILKSFCDSGRSQLALDLLRVMAKKGGDHSPDVMAYNMVSKACDLFHEMIQQGVVPNEGDI

SEQ ID NO: 1554 - protein, 195 aa, Triticum aestivum
MDEVSKLLENMCSIGLKLDVVTYSILIDGYSKNGRIDDALVVFREMMDGKVEPSVITFNIMIGALLKGGRKEEATDLFNGIWPKGLVPDVVTYSLMIQKLIEEGSLQESDDLFLSMEKNGCAANSHMLNAIVRSLLQKGEIPRAGTYLSKIDERRFTFEASTASLLAALASGGKGQEYKELLPEKYHYFLEQGAD

SEQ ID NO: 1555 - DNA, 2949 bp, Triticum aestivum
atgcttacaaatatcgggatacttaaaaaaataataccattttatggcttctgtggcgcgttttctagggcttgcaacaaatttatattcttggtcgatataaagttctattcttacagactgggtgatacgaatatccatatcataattttattgtacctgaaaagaactcatatattatctctgtatcaaaatattggacgtttgtacacctggaaaagcactcgtcttgctccgatttcacgacctaccaccaccaaggccatgcctcgcttctcctccaccacgcccatgtcgccactccgcctccgcctccgccgccgcctccgcgcccgccactcctcctccacctcccattcctcacgcagctgggagccccacgccgccttcgccgccgccacggagcgtgcgcgctctggcaacctcaccccggaggacgcacaccacctgttcgacgaattgctccggcagggcaatcctgtccaggaccgccccttgaacaaacttctctctgccctcgcccgtgctccggcgtccgcggcctgcagaaacggccctgcactcgcggttgctctcttcagccgcatatcccaaggtgctcgccgacgggtggcggagccaacggcctgcacctacaccatcctcatggactgttgctgccgcgcacaccgcctggatctggcgctcgccttcttcggccgtctcctcaggacgggactgaagacgggcgtcatagaagtcaacaccctcctcaaaggactctgtcactcaaagcgcgcggatgaggccatggaagtgcttcttcacaggatgcctgagctgggctgcacccctgacgtggtggcgtgtaacacggtcatccatggcttcttcaaggaaggccaagtaggcaaggcgtgcaatctgtttcatgaaatggggcagcacggcgttacacctgatgtggtgacatataactcggttatcgatgggctgtgcaaggccagagccatggacaaggcagaggtggtccttcatcagatgcttgttaatggtgtcgtacctgataaggtgacatatggcagcctcatcgatggatattactctttggcccattggaaggaggcagttaggctgttcgaggaaatgaaaagtcagagggttacaccagatgtgcatacttacaacttgtgtatccatggcttctttagggaaggccaagtaggcaaggcgtgcaatctattccatgaaatggggcagcagggcgttacacctgatgtggtgacatataattcggttatcgatgcgctgtgcaaggccagagcaatggacaaggcggagtatttccttcgtcagatggttgatagtggtgtcgtacctaataatgtgacatataatagcctcatccatggatattcctcttcaggctatcagaaggaggcggttagggtgctgaaagaaatgacaagtcagggtatcataccagatgtttttactttcaactcgcttatggcctccctttccaagaatggaagaagcaaagaagctgcagaaatttttgactccatggccatgaagggcctgaaacctgatatcgtctcgtacaatactctgcttcacgggtatgccaccgaaggatgcttagttggtatgactaatttctttaattcaatgactagagatggtattcggcctaactgtcacactttgaacatactgattaatgcatatgctaaatctggcatgatggatgaggctatggttatatttaaaggaatgcggaaacagggagtgagtccagatgtagtcacctattcaaccgtaatacatggattttgcaaaatcggtaggttggacaatgctatggtaaaatttaagcagatgactgatatgggagtacgaccgaatccaattgtttatcattccctaatccagggtttttgtacacatggggatttagtgaaagcaaaggaattggttactgaaatgaggtacaaaggtatgcgtcctcctgatattaaggtcttccatttggcaatgcagaacctatgcacggaaggaagagtaacaaaagcacgggatatccttgacttgattgtgcacataggtatgaggcctgatgttttcacatttagtttactgatcggtggatactgcttagtctgcaagatggaggatgcatcaaaaatatttgatgatatggtgtcatatggtttagaaccttctaatattacatatggtatacttattaatggctattgcaaaaacaaaaggattgacgatgggctgattctattcaaaacaatgttgcacaagggacttaaacctacaacttttaattataacgtcatactggatggattatttctggctggacgaacagttgctgcaaaagagaagtttaatgagatggttgaatctggagtaagtgtgtgcattgatacatgctctatagttcttggtggactttgtaaaaatagctgcagcagcgaagcgatcaccctgttccggaaattaagcacaatgaatgtgaaatttgatattaatattgtcaatatcattattggtgcattctacagtgtcaagagaaaccaagaggctaaggatttgtttgctgctataccagccaatggcttggttcctaatgctgttacctacaccataatgatgacaaatcttataaaagaaggttcagtggaagaagccgacaatctttttttatcaatggagaagagcggctgtactgcaaactcttggatgttaaatcatattatcagaaggttactggaaagaggagagatagtcaaggctggaaattatatgtctaaagttgatgtaaagagctactcacttgaagctaaaactgtttcactgctgatctctctgttttcaagggaagggaaatatagagaccacatcaaattgctccctacaaagtatcagtttctggaagaagcagccacagttgaa

SEQ ID NO: 1556 - DNA, 1320 bp, Triticum aestivum
atgactaatctctttaattcaatgactagagatggtattcggcctaactgtcacactttgaacatactgattaatgcatatgctaaatctggcatgatggatgaggctatgcttatatttaaaggaatgcggaaacagggagtgagtccaaatgtagtcacctattcaaccgtaatacatgggttttgcaaaatcggtaagttggacaatgctatggtaaaatttaagcagatgactgatatgggagtacgaccgaatccaattgtttatcattccctaatccaggggttttgtacacatggggatttagtgaaagcaaaggaattggttactgaaatgaggtacaaaggtatgcgtcctcctgatattaaggtcttccatttggcaatgcagaacctatgcacggaaggaagagtaacaaaagcacgggatatccttgacttgattgtgcacataggtatgaggcctgatgttttcacatttagtatactgatcggtggatactgcttagtctgcaagatggaggatgcatcaaaaatatttgatgatatggtgtcatatggtttagaaccttctaatattacatatggtatacttattaatggctattgcaaaaacaaaaggattgacgatgggctgattctattcaaaacaatgttgcacaagggacttaaacctacaacttttaattataacgtcatactggatggattatttctggctggacgaacagttgctgcaaaagagaagtttaatgagatggttgaatctggagtaagtgtgtgcattgatacatgctctatagttcttggtggactttgtaaaaatagctgcagcagcgaagcgatcaccctgttccggaaattaagcacaatgaatgtgaaatttgatattaatattgtcaatatcattattggtgcattctacagggtcaagagaaaccaagaggctaaggatttgtttgctgctataccagccaatggcttggttcctaatgctgttacctacaccataatgatgacaaatcttataaaagaaggttcagtggaagaagccgacaatctttttttatcaatggagaagagcggctgtactgcaaactcttggatgttaaatcatattatcagaaggttactggaaagaggagagatagtcaaggctggaaattatatgtctaaagttgatgtaaagagctactcacttgaagctaaaactgtttcattgctgatctctctgttttcaagggaagggaaatatagagaccacatcaaattgctccctacaaagtttcagtttctggaagaagcagccacagttgaa

SEQ ID NO: 1557 - DNA, 2751 bp, Triticum aestivum
atgcggtcttgtttctgcaatagagcgtttatcgcgggatgtaacgagtgggcatgtggggcgtggacgctacatcggacggctatcagctcatgcatccaacgatcgtcgaggcgacggtctaaacatcggccgggcgatttattacaagttactaggaccactattttgggacggaggagggaatatgtatttgtgataaaaaaaaaaagagtggtatacctccacaagcaaagcaataccggatcctcctccaaacggctgaccagtccagtcccgtcccgcctcccccgccgctcgccgatgtccagcctccacctcctccgccaccgctcctcctccttcactcccacctcgccgccctcaccctcctggtctccgcacgccgcctttaccgctgccacagagcgcgtccgcgccgggacgctcagcccggaagacgcacaccacctgttcgaccaattgctacagcagtccactccggtccccgagcaagccctgaacggcttccttgccgccctcacccgtgcccgtgcgccagacaccgaagtctgcagagacggcccctcccttgccctcacgctcttcaaccgcgtatggcgagaagaagccggccggcgggtggcgctgcccacagtccgcacctacaacattctgatgaactgctgctgccgcgtgcgtcgtccggacctagggcttgcctacttcgggcgcctcctaaggaccagcctcaaaacaaatgaggtcgtcgccaacaccgtcctcatgtgcctctgctgcgcgaaacggacagatgaagcagtaaacgtgctgcttcataggatgtctgtgctcggctgtgtgcctgatgagttctcatataacatagttctgaagagcttatgcaaagagggaaggagccagcaagcgctcaacctgctccatgtgatggcaaaaggagatggttgctcccccgacgtggtggcttataacacggtcatctatggcttctttaaggaaggtgaagtaggcaaggcatgcaatctattccatgaaatgatgcggcaaggggttgtgcctgatgtggtgacgtatagctcgattatcgatgcactgtgcaaggctggagcaatggacaaggcagagttgttccttcggcagatggttgataacagtgttcagccggatacggtgacatatactagcatgatccatggatattccactttgggccgctggaaagaggcgactaaaatgttaagagaaatgacaagcaggggccttataccaaatattgtcacttggaactcgttcatggcctccctttgcaagcatggaaaaagcaaagaagctgcagaaattttcttttccatggctgcaaggggccacaagcctgatatcgtctcctacactactcttcttcatgggtatgccaatgaaggaagctttgctgatatgatgaaactctttaattcaatggtaggcaacggtattgtagccaactgccaagttttcaacatattaattgatgcatatgctcaacgaggaatgatggacgaagctatgctcatatttactgaaatgccaggacaaggagtcaatccaaatgtagtcacctattcaattgtgatagctgcactttgcagaatgggtaggctggctgatgcaatgaataagttcagtgagatgattggtacgggagtacaaccgaacatagttgtttatcactccctagttcagggcttatgtacacatggtgatttggtgaaagcgaaggtgttgatttctgaaatgatgaataaaggtattgctcgtccaaacattgcattcttcagttcaataatgggcagtctatgcaacgaaggaaggattatgaatgcacatgatatctttgacttggttacagacataggtgtgaaacctgatgttataacatttaatatgctgatggtcggatattgcttagttggcgagatggagaaagcattcaaggtacttgatgccatggtatcagttggcattgagcctgatgttgttacttatagctcacttattagtggctattgtaagactggaaggctcgacgatggtgttacactattcagagaaatgttgcataagagaattaaacctgacactgtttcctataacaccatactggatgggttatttaatgctgggagaactgctgctgcaaggaaaatgttccatgagatgatcgaaagtggagtaatggtgagcatttctacatataatataattcttggaggactttgtagaaataattgcatggatgaagcgatcgtcctattccggaaattacgtgcagtgaatgtgaagttcaatatcacaacactcaataccatcatcaatgcattatacaatgttcaaagaagagaagaagctcatgatttgtttgctgcattaccagccagccggctggtgcctaatgcttctacttacagagtaatgatagataatcttctaaaagaaggagcagtggaagaagctgacagtatgttctcatcaatggagaagagtggttgtgctcctagctctcattttttaaattatatcatcagaatgttattggaaaaaggggagatagtcaaggccggaaaatatatgtctaaagttgatgggaagattattttgcttgaagcttcaactacttcattgctgatgtccctcttctcaaggggaggcaaataccaggagcacatactcttgctccctgcaaaatatcattttttcagtggagtgaaccacagt

SEQ ID NO: 1558 - DNA, 2448 bp, Triticum aestivum
atgtccagcctccacctcctccgccaccgctcctcctccttcactcccacctcgccgccctcaccctcctggtctccgcacgccgcctttaccgctgccacagagcgcgtccgcgccgggacgctcagcccggaagacgcacaccacctgttcgaccaattgctacagcagtccactccggtccccgagcaagccctgaacggcttccttgccgccctcacccgtgcccgtgcgccagacaccgacgtctgcagagacggcccctcccttgccctcacgctcttcaaccgcgtatggcgagaagaagccggccggcgggtggcgctgcccacagtccgcacctacaacattctgatgaactgctgctgccgcgtgcgtcgtccggacctagggcttgcctacttcgggcgcctcctaaggaccagcctcaaaacaaatgaggtcgtcgccaacaccgtcctcatgtgcctctgctgcgcgaaacggacagatgaagcagtaaacgtgctgcttcataggatgtctgtgctcggctgtgtgcctgatgagttctcatataacatagttctgaagagcttatgcaaagagggaaggagccagcaagcgctcaacctgctccatgtgatggcaaaaggagatggttgctcccccgacgtggtggcttataacacggtcatctatggcttctttaaggaaggtgaagtaggcaaggcatgcaatctattccatgaaatgatgcggcaaggggttgtgcctgatgtggtgacgtatagctcgattatcgatgcactgtgcaaggctggagcaatggacaaggcagagttgttccttcggcagatggttgataacagtgttcagccggatacggtgacatatactagcatgatccatggatattccactttgggccgctggaaagaggcgactaaaatgttaagagaaatgacaagcaggggccttataccaaatattgtcacttggaactcgttcatggcctccctttgcaagcatggaaaaagcaaagaagctgcagaaattttcttttccatggctgcaaggggccacaagcctgatatcgtctcctacactactcttcttcatgggtatgccaatgaaggaagctttgctgatatgatgaaactctttaattcaatggtaggcaacggtattgtagccaactgccaagttttcaacatattaattgatgcatatgctcaacgaggaatgatggacgaagctatgctcatatttactgaaatgccaggacaaggagtcaatccaaatgtagtcacctattcaattgtgatagcttcactttgcagaatgggtaggctggctgatgcaatgaataagttcagtgagatgattggtacgggagtacaaccgaacatagttgtttatcactccctagttcagggcttatgtacacatggtgatttggtgaaagcgaaggtgttgatttctgaaatgatgaataaaggtattactcgtccaaacattgcattcttcagttcaataatgggcagtctatgcaacgaaggaaggattatgaatgcacatgatatctttgacttggttacagacataggtgtgaaacctgatgttataacatttaatatgctgatggtcggatattgcttagttggcgagatggagaaagcattcaaggtacttgatgccatggtatcagttggcattgagcctgatgttgttacttatagctcacttattagtggctattgtaagactggaaggctcgacgatggtgttacactattcagagaaatgttgcataagagaattaaacctgacactgtttcctataacaccatactggatgggttatttaatgctgggagaactgctgctgcaaagaaaatgttccatgagatgatcgaaagtggagtaatggtgagcatttctacatataatataattcttggaggactttgtagaaataattgcatggatgaagcgatcgtcctattccggaaattacgtgcagtgaatgtgaagttcaatatcacaacactcaataccatcatcaatgcattatacaatgttcaaagaagagaagaagctcatgatttgtttgctgcattaccagccagccggctggtgcctaatgcttctacttacagagtaatgatagataatcttctaaaagaaggagcagtggaagaagctgacagtatgttctcatcaatggagaagagtggttgtgctcctagctctcattttttaaattatatcatcagaatgttattggaaaaaggggagatagtcaaggccggaaaatatatgtctaaagttgatgggaagattattttgcttgaagcttcaactacttcattgctgatgtccctcttctcaaggggaggcaaataccaggagcacatactcttgctccctgcaaaatatcattttttcagtggagtgaaccacagt

SEQ ID NO: 1559 - DNA, 2904 bp, Triticum aestivum
atggcggcggcgccgcgcgggttgcagctctgtcggagccgggggcaagagtatgttgtttctgtaacagagcgtttgttgcgggaaataacgagtgggcatgcggtcttgttttctgcaacagaacgtttgttgcgggaagtacgagtgggcatgcggtcttgtttctgcaatagagcgtttatcgcgggatgtaacgagtgggcatgtggggcgtggacgctacatcggacggctatcagctcatgcatccaacgatcgtcgaggcgacggtctaaacatcggccgggcgatttattacaagttactaggaccactattttgggacggaggagggaatatgtatttgtgataaaaaaaaaaagagtggtatacctccacaagcaaagcaataccggatcctcctccaaacggctgaccagtccagtcccgtcccgcctcccccgccgctcgccgatgtccagcctccacctcctccgccaccgctcctcctccttcactcccacctcgccgccctcaccctcctggtctccgcacgccgcctttaccgctgccacagagcgcgtccgcgccgggacgctcagcccggaagacgcacaccacctgttcgaccaattgctacagcagtccactccggtccccgagcaagccctgaacggcttccttgccgccctcacccgtgcccgtgcgccagacaccgaagtctgcagagacggcccctcccttgccctcacgctcttcaaccgcgtatggcgagaagaagccggccggcgggtggcgctgcccacagtccgcacctacaacattctgatgaactgctgctgccgcgtgcgtcgtccggacctagggcttgcctacttcgggcgcctcctaaggaccagcctcaaaacaaatgaggtcgtcgccaacaccgtcctcatgtgcctctgctgcgcgaaacggacagatgaagcagtaaacgtgctgcttcataggatgtctgtgctcggctgtgtgcctgatgagttctcatataacatagttctgaagagcttatgcaaagagggaaggagccagcaagcgctcaacctgctccatgtgatggcaaaaggagatggttgctcccccgacgtggtggcttataacacggtcatctatggcttctttaaggaaggtgaagtaggcaaggcatgcaatctattccatgaaatgatgcggcaaggggttgtgcctgatgtggtgacgtatagctcgattatcgatgcactgtgcaaggctggagcaatggacaaggcagagttgttccttcggcagatggttgataacagtgttcagccggatacggtgacatatactagcatgatccatggatattccactttgggccgctggaaagaggcgactaaaatgttaagagaaatgacaagcaggggccttataccaaatattgtcacttggaactcgttcatggcctccctttgcaagcatggaaaaagcaaagaagctgcagaaattttcttttccatggctgcaaggggccacaagcctgatatcgtctcctacactactcttcttcatgggtatgccaatgaaggaagctttgctgatatgatgaaactctttaattcaatggtaggcaacggtattgtagccaactgccaagttttcaacatattaattgatgcatatgctcaacgaggaatgatggacgaagctatgctcatatttactgaaatgccaggacaaggagtcaatccaaatgtagtcacctattcaattgtgatagctgcactttgcagaatgggtaggctggctgatgcaatgaataagttcagtgagatgattggtacgggagtacaaccgaacatagttgtttatcactccctagttcagggcttatgtacacatggtgatttggtgaaagcgaaggtgttgatttctgaaatgatgaataaaggtattgctcgtccaaacattgcattcttcagttcaataatgggcagtctatgcaacgaaggaaggattatgaatgcacatgatatctttgacttggttacagacataggtgtgaaacctgatgttataacatttaatatgctgatggtcggatattgcttagttggcgagatggagaaagcattcaaggtacttgatgccatggtatcagttggcattgagcctgatgttgttacttatagctcacttattagtggctattgtaagactggaaggctcgacgatggtgttacactattcagagaaatgttgcataagagaattaaacctgacactgtttcctataacaccatactggatgggttatttaatgctgggagaactgctgctgcaaggaaaatgttccatgagatgatcgaaagtggagtaatggtgagcatttctacatataatataattcttggaggactttgtagaaataattgcatggatgaagcgatcgtcctattccggaaattacgtgcagtgaatgtgaagttcaatatcacaacactcaataccatcatcaatgcattatacaatgttcaaagaagagaagaagctcatgatttgtttgctgcattaccagccagccggctggtgcctaatgcttctacttacagagtaatgatagataatcttctaaaagaaggagcagtggaagaagctgacagtatgttctcatcaatggagaagagtggttgtgctcctagctctcattttttaaattatatcatcagaatgttattggaaaaaggggagatagtcaaggccggaaaatatatgtctaaagttgatgggaagattattttgcttgaagcttcaactacttcattgctgatgtccctcttctcaaggggaggcaaataccaggagcacatactcttgctccctgcaaaatatcattttttcagtggagtgaaccacagt

SEQ ID NO: 1560 - DNA, 2751 bp, Triticum aestivum
atgcggtcttgtttctgcaacagagcgtttatcgcgggatgtaacgagtgggcatgtggggcgtggacgctacatcggacggctatcagctcgggcatccaacgatcgtcgaggcgacggtataaacatcagccgggcgatttattacaagttactaggaccactattttgggacggaggagggaatatgtatttgtgataaaaaaaaaaagagtggtatacctccacaagcaaagcaataccggatcctcctccaaacggctgaccagtccagtcccgtcccgcctcccccgccgctcgccgatgtccagcctccacctcctccgccaccgctcctcctccttcactcccacctcgccgccctcaccctcctggtctccgcacgccgcctttaccgctgccacagagcgcgtccgcgccgggacgctcagcccggaagacgcacaccacctgttcgaccaattgctacagcagtccactccggtccccgagcaagccctgaacggcttccttgccgccctcacccgtgcccgtgcgccagacaccgacgtctgcagagacggcccctcccttgccctcacgctcttcaaccgcgtatggcgagaagaagccggccggcgggtggcgctgcccacagtccgcacctacaacattctgatgaactgctgctgccgcgtgcgtcgtccggacctagggcttgcctacttcgggcgcctcctaaggaccagcctcaaaacaaatgaggtcgtcgccaacaccgtcctcatgtgcctctgctgcgcgaaacggacagatgaagcagtaaacgtgctgcttcataggatgtctgtgctcggctgtgtgcctgatgagttctcatataacatagttctgaagagcttatgcaaagagggaaggagccagcaagcgctcaacctgctccatgtgatggcaaaaggagatggttgctcccccgacgtggtggcttataacacggtcatctatggcttctttaaggaaggtgaagtaggcaaggcatgcaatctattccatgaaatgatgcggcaaggggttgtgcctgatgtggtgacgtatagctcgattatcgatgcactgtgcaaggctggagcaatggacaaggcagagttgttccttcggcagatggttgataacagtgttcagccggatacggtgacatatactagcatgatccatggatattccactttgggccgctggaaagaggcgactaaaatgttaagagaaatgacaagcaggggccttataccaaatattgtcacttggaactcgttcatggcctccctttgcaagcatggaaaaagcaaagaagctgcagaaattttcttttccatggctgcaaggggccacaagcctgatatcgtctcctacactactcttcttcatgggtatgccaatgaaggaagctttgctgatatgatgaaactctttaattcaatggtaggcaacggtattgtagccaactgccaagttttcaacatattaattgatgcatatgctcaacgaggaatgatggacgaagctatgctcatatttactgaaatgccaggacaaggagtcaatccaaatgtagtcacctattcaattgtgatagcttcactttgcagaatgggtaggctggctgatgcaatgaataagttcagtgagatgattggtacgggagtacaaccgaacatagttgtttatcactccctagttcagggcttatgtacacatggtgatttggtgaaagcgaaggtgttgatttctgaaatgatgaataaaggtattactcgtccaaacattgcattcttcagttcaataatgggcagtctatgcaacgaaggaaggattatgaatgcacatgatatctttgacttggttacagacataggtgtgaaacctgatgttataacatttaatatgctgatggtcggatattgcttagttggcgagatggagaaagcattcaaggtacttgatgccatggtatcagttggcattgagcctgatgttgttacttatagctcacttattagtggctattgtaagactggaaggctcgacgatggtgttacactattcagagaaatgttgcataagagaattaaacctgacactgtttcctataacaccatactggatgggttatttaatgctgggagaactgctgctgcaaagaaaatgttccatgagatgatcgaaagtggagtaatggtgagcatttctacatataatataattcttggaggactttgtagaaataattgcatggatgaagcgatcgtcctattccggaaattacgtgcagtgaatgtgaagttcaatatcacaacactcaataccatcatcaatgcattatacaatgttcaaagaagagaagaagctcatgatttgtttgctgcattaccagccagccggctggtgcctaatgcttctacttacagagtaatgatagataatcttctaaaagaaggagcagtggaagaagctgacagtatgttctcatcaatggagaagagtggttgtgctcctagctctcattttttaaattatatcatcagaatgttattggaaaaaggggagatagtcaaggccggaaaatatatgtctaaagttgatgggaagattattttgcttgaagcttcaactacttcattgctgatgtccctcttctcaaggggaggcaaataccaggagcacatactcttgctccctgcaaaatatcattttttcagtggagtgaaccacagt

SEQ ID NO: 1561 - DNA, 2751 bp, Triticum aestivum; identical to SEQ ID NO: 1560

SEQ ID NO: 1562 - DNA, 2751 bp, Triticum aestivum; identical to SEQ ID NO: 1557

SEQ ID NO: 1563 - DNA, 1512 bp, Triticum aestivum
atgctcagaaaaatgacaacccggggtcttataccagatattgttacttgcagctcgttaatgacttccctttgcaagcatggaagaagcaaagaagcgttagacattttttgttccatgactgccaaaggcctcaaacctaatatcatcgcatactctattctgcttcatggatatgccaccgaaggatgctttgttgatatgattaatctctttaattcaatggaagacaatggtattgcagccaactgttatgttttcaacatattaattgatgcatatgctaaacatggaatgatggatgaagctatgctcatatttaccgaaatgcgggaaaaaggagtgagtcctgatgtagtcacctattccactgtaataaccgcattttgcagattgcgtaggctggccgatgctatggacaagttcaatgagatgactgatatgggtgttcagccggacacaactgtttatcactccttaattcagggcttttgtatgcatggtgatttggttaaagctaaggggctggtttctgaaatgacgaacaaaggtattcctcgtcctgacattgtgttcttcagttcaataataaacactctatgcaaagaaggaagggttatggatgcacaagatatctttgaaatggttataagcatagatgggagacctgatgtcattacattcagttcactgattgacggatatggcttagtcggccagatgggtaaagcactcggagtgcttgatgccatggtatcagctggcattgagcctgatgttgttacgtatagttcacttcttgatggctattgtagaaatggaaggatcaatgatgctttgattctatttagagaaatgccgcataagagaattaaacctaacactgttacatatggcatcatactggatgggttgtttcgtgctggaagaactgttgatgcaaggaaaatgttccatgagatgatcgaaaggggtataacagtgagcatttccatatacaatataatacttggaggtctttgtagaaataattgtgcagatgaagcgatcgcactgttccagaaattaggagcaatgaatgtaaagttcaacattataacactcaataccatgattaatgcaatgttcaaggttcggagaagagaagaagctaacgatttgtttgctgcaatatcagccggtgggttggtgcctaatgcttctacttacggcataatgataaaaaatattctaaaagaaggatcagtggaagaagttgacagtatgttttcatcaatggagaagagtggtataattcccaactcctgtcttataaatattatcatcagaatgttgttggaaaaaggtgagattgccaaggccagaaattatttatctaaagttgatgggaaggtcatctcacttgaagcttcaactacttctttgttgctgtctctcttttcaaggaaagggaaatatcgggaaagcattgaattgcttcctgcaaactatcaatttttcgatggatttggt

SEQ ID NO: 1564 - DNA, 2091 bp, Triticum aestivum
atgggctgcttctgcggtgcgcgtcgcccggacctagggcttgccttatttggccacttcctcaggacaggcctcaagacaaacaagattgtggccaccaccttcctcaagtgcctctgctgcgccaaacgtacagatgaggctgtcaacgtgctgcttcataggatgcccgagcttggctgtgtgcctgatgccttctcatactccatagttttgaagagcttatgtgaaaatagcatgagtcagcgggcactcgacctgctccagatggtggctaaagggggagatgcctgctctgtcaatgtggtggcatataacacggtcatccatggcttcttcaaggagggcgaaacaggcaaggcatgcaatctattccatgaaatgatccatcaaggggttgtgcccgatgtcgtgacatttaactcgattattcatgccttgtgcaaggccagagcaatggacaaggcagagattgtccttcggcagatggttgataatggtgctcaacccaatgaagtgacatataattgcatgatccatggatattcgaaatcagggcagttaagagagggtactaaaatgctcagaaaaatgacaacccggggtcttataccagatattgttacttgcagctcgttaatgacttccctttgcaagcatggaagaagcaaagaagcgttagacattttttgttccatgactgccaaaggcctcaaacctaatatcatcgcatactctattctgcttcatggatatgccaccgaaggatgctttgttgatatgattaatctctttaattcaatggaagacaatggtattgcagccaactgttatgttttcaacatattaattgatgcatatgctaaacatggaatgatgggtgaagctatgctcatatttaccgaaatgcgggaaaaaggagtgagtcctgatgtagtcacctattccactgtaatagccgcattttgcagattgcgtaggctggccgatgctatggacaagttcaatgagatgactgatatgggtgttcagccggacacaactgtttatcactccttaattcagggcttttgtatgcatggtgatttggttaaagctaaggggctggtttctgaaatgacgaacaaaggtattcctcgtcctgacattgcgttcttcagttcaataataaacactctatgcaaagaaggaagggttatggatgcacaagatatctttgaaatggttataagcatagatgggagacctgatgtcattacattcagttcactgattgacggatatggcttagtcggccagatgggtaaagcactcggagtgcttgatgccatggtatcagctggcattgagcctgatgttgttacgtatagttcacttcttgatggctattgtagaaatggaaggatcaatgatgctttgattctatttagagaaatgccgcgtaagagaattaaacctaacactgttacatatggcatcatactggatgggttgtttcgtgctggaagaactgttgatgcaaggaaaatgttccatgagatgatcgaaaggggtataacagtgagcatttccatatgcaatataatacttggaggtctttgtagaaataattgtgcagatgaagcgatcgcactgttccagaaattaggagcaatgaatgtaaagttcaacattataacactcaatgccatgattaatgcaatgttcaaggttcggagaagagaagaagctaacgatttgtttgctgcaatatcagccagtgggttggtgcctaatgcttctacttacggcataatgataaaaaatattctaaaagaaggatcagtggaagaagttgacagtatgttttcatcaatggagaagagtggtataattcccaactcctgtcttataaatattatcatcagaatgttgttggaaaaaggtgagattgccaaggccggaaattatttatctaaagttgatgggaaggtcatctcacttgaagcttcaactacttctttgttgctgtctctcttttcaaggaaagggaaatatcgggaaagcattgaattgcttcctgcaaactatcaatttttcgatggatttggt

SEQ ID NO: 1565 - DNA, 2091 bp, Triticum aestivum; identical to SEQ ID NO: 1564

SEQ ID NO: 1566 - DNA, 1512 bp, Triticum aestivum; identical to SEQ ID NO: 1563

SEQ ID NO: 1567 - DNA, 2091 bp, Triticum aestivum; identical to SEQ ID NO: 1564

SEQ ID NO: 1568 - DNA, 2091 bp, Triticum aestivum; identical to SEQ ID NO: 1564

SEQ ID NO: 1569 - DNA, 2439 bp, Triticum aestivum
atgtccggcgtctgcctccgccgccgcctctcctccacctccacctccaacacgccaccctcaccttcctggtcaccccaggccgcctttgccgcggccacggagcgcgcccgcgccggaacgctcagccctcaagacgcacaccacctgttcgacgaattgtttcggcaggccactccggttcccgagcgctcccttgaaggattccttgccgccctcggccgtgctgcatcctctgaagcctgcagagacggcccctcccttgccctcactctcttcaaccgtctctgccgagaagaagccggccggcgggtggcgccgcccacaatctacacctacggcatcctgatgaactgctgctgccgcgtgcgtcgtccagacctagggctcgccttcttcggccgcctcctaaggaccggcctcaaaacaaatgaggtcgtcgccagcaccctcctcaagtgcctctgctgtgcaaaacgggcagatgaagctgtgaacgtgctgcttcataggatgtccgtcctcggctgtgtgcctaattccttctcatacaacatagttctaaagagcttatgtgatgacagcaggagccagcgagcgctcggcctgctccagatgatggcaaaaggaggtgtctgctcccccaacgttctgtcatataacacagtcatccacggcttctttaaggaaggtgaaatagacaaggcctgcaatctattccatgaaatgacgaagcaagggtttgtgcctaatgtggtgacatataactcggttatcaatgcattgtgcaaggcccgagcaatggacaatgcagagtcgttccttcggcagatggttgataacggtgttccacctgataaggtgacatatactagcatcatccatggatattccactttgggccgatggaaagaggcaactaaaatgttcagagaaatgacaagcaggggtcttataccagatattgtcactcggaactcattcatggactcactctgcaagcatggaagaagcaaagaagctgcagaaattttcttttccatggctgcaaggggccacaagcctgatatcgtctcctacactattcttctccatgggtatggcaatgaaggaagcttttctgatatgatgagtctctttaattcaatggaaggcggcggtattgtggccgattgccaagttttcaacatattaattgatgcatatgctaaacgaggaatgatcgacgaagctatgctcatatttactgaaatgctaggacaaggagtcaatccgagtgtagtcacctactcaactctgatagctgcactttgcagaacaggtaggctagctgatgctatggataagtttagtcagatggttggtacgggagtacaaccggacacagttgtttatcactccctaattcagggtttctgtacacatggcgatttggtcaaagcgaaggaattgatttctgaaatgatgaataaaggtattatttgtccaaacattgcattcttcaattcaatagtagacagtctatgcaaagaaggaagggttatggatgcacaccatatctttgacttggttaaagacataggtgagaaacctgatgccatcatgtttaatacgctaattgacggatattgcttagttggtgagatgggcaaagcattcatggtacttgatgtcatgacatcagctggcattgagcctgatgccattacgtatagtacacttgtcagtggatattgtaaaagtggaaggatcgatgatgggttgattctgttcagagaagaaatgttgcataagaaagttaaaccaacaattgttacatataacatcatattggaggggttatttcgtgctgggagaacagttgctgcaaagaaaatgctccatgaaattatcggaagtgggacacctgtgagcatgcatacatacgacatatttcttagaggactttgtagaaataattgcgcggatgaagcgatcgtcctattccagaaatcacgtgcaatgaatgtgaagttcaatatcacaacactcaataccatgattaatgcattctacaagggtgacagaagagaagaagctaatgatttgtttgctgcattaccagccagcgggttggtgcctaatgcttccacttacggagtaatgatacaaaaccttctaaaagaaggagcagtggaggaagctgacaatatgttctcatcaatggagaagagtggttgtgctcctagctctcgtcttgtgaatgatgtcatcagaactttattggaaaagggggagatagtcaaggccggaaaatatatgtctaaagtttatgggaagagcctatcacttgatgcttcaactagttcgttgttgttgtctctcttttcagggaatgggaaatatcgggaacaaatacaattgctccctgcaaagtaccagtttttcggtggaatcagt

SEQ ID NO: 1570 - DNA, 2439 bp, Triticum aestivum; identical to SEQ ID NO: 1569

SEQ ID NO: 1571 - DNA, 2439 bp, Triticum aestivum; identical to SEQ ID NO: 1569

SEQ ID NO: 1572 - DNA, 2439 bp, Triticum aestivum; identical to SEQ ID NO: 1569

SEQ ID NO: 1573 - DNA, 2439 bp, Triticum aestivum; identical to SEQ ID NO: 1569

SEQ ID NO: 1574 - DNA, 2439 bp, Triticum aestivum; identical to SEQ ID NO: 1569

SEQ ID NO: 1575 - DNA, 1824 bp, Triticum aestivum
atgatggcaaaaggaggtgtctgctcccccaacgttctgtcatataacacggtcatccatggcttctttaaggaaggtgaaataggcaaggcctgcaatctattccatgaaatggcgaagcaagggtttgtgcctaatgtggtgacatataactcggttatcaatgcattgtgcaaggcccgagcaatggacaatgcagagtcgttccttcggcagatggttgataacggtgttccacccgataaggtgacatatactagcatcatccatggatattccactttgggccgatggaaagaggcaactaaaatgttcagagaaacgacaagcaggggtcatataccagatattgtcactcggaactcattcatggactcactctgcaagcatggaagaagcaaagaagctgcagaaattttcttttccatggctgcaaggggccacaagcctgatatcgtctcctgcactattcttctccatgggtatggcaatgaaggaagcttttctgatatgatgagtctctttaattcaatggaaggcggcggtattgtggccgattgccaagttttcaacatattaattgctgcatatgctaaacgaggaatgatcgacgaagctatgctcatatttactgaaatgctaggacaaggagtcaatccgagtgtagtcacctactcaactctgatagctgcactttgcagaacaggtaggctagctgatgctatggataagtttagtcagatggttgatacgggagtacaaccggacacagttgtttatcactccctaattcagggtttctgtacacatggcgatttggtcaaagcgaaggaattgatttctgaaatgatgaataaaggtatgatttgtccaaacattgcattcttcaattcaatagtagacagtctatgcaaagaaggaagggttatggatgcacaccatatctttgacttggttaaagacataggtgagaaacctgatgtcatcatgtttaatacgctaattgacggatattgcttagttggtgagatgggcaaagcattcatggtacttgatgtcatgacatcagctggcattgagcctgatgccattacgtatagtacacttgtgagtggatattgtaaaagtggaaggatcgatgatgggttgattctgttcagagaagaaatgttgcataagaaagttaaaccaacaattgttacatataacatcatattggaggggttatttcgtgctgggagaacagttgctgcaaagaaaatgctccatgaaattatcggaagtgggacacctgtgagcatgcatacatacgacatatttcttagaggactttgtagaaataattgcgcgaatgaagcgatcgtcctattccagaaatcacgtgcaatgaatgtgaagttcaatatcacaacactcaataccatgattaatgcattctacaagggtgacagaagagaagaagctaatgatctgtttgctgcattaccagccagcgggttggtgcctaatgcttccacttacggagtaatgatacaaatccttctaaaggaaggagcagtggaggaagctgacaatatgttctcatcaatggagaagagtggttgtgctcctagctctcgtcttgtgaatgatgtcatcagaactttattggaaaagggggagatagtcaaggccggaaaatatatgtctaaagttgatgggaagagcatatcacttgatgcttcaactagttcgttgttgttgtctctcttttcagggaatgggaaatatcgggaacaaatacaattgctccctgcaaagtaccagtttttcggtggaatcagt

SEQ ID NO: 1576 - DNA, 2640 bp, Triticum aestivum
atgctccgccgcatccgcatctccactcctgtcatcggaggaaaaaaagctcccgtacgaactcccgacgccgatgctccgcggcatccgcacccgcctccgtcgccgcccctccccctcctgcacctagccggcgtccgttctccgcctccctctccgccactcgtccgcctccaccagtaccgcaccaccagcacgccgatgtcccgcatccacctccacctccaccaacaccgccgcctcttctcctccacctcgccgccctcgcgctcctggtctccccacgaagcctttgccgcggccacagagcgcgtccgcgccgggaatttcagctgggaagacgcacacaacctgttcgacgaattgctgcggcaggccaccccggtccccgggcgctccctcaacggcttccttgccgccctcgcccgtgcgcccgcctccgaagcctgcagagatggtcccgccctcgccctcgctctcttcaaccacgtctgccgggacgaatccggcgcgcgggtggcaccgcccacaatcttcacgtacggcattctcatgaactgctgctgtcgtgcgcatcgcccggacctagggctagccttcttcggtcgcctcctcaggacgggcctgaaggctgacctgatcgtcgccaacaccctccttaagtgtctctgccgcgcgaaacggacggatgaggctgtgaacgtgctgcttcataggatgtctgagctcggctgtgtgcctgatgccttctcatactccattgttctcaagagcttatgcgacaatggcatgagtcagcaggcgctcaacctgctccatatgatggcgaaagtaggaggtggctgctcccccgacgtggtggcgtatagcacagtcatccatggcttctttaaggaaggtgaaacaggcaaggcatgcaatctgttccatgaaatgatgcagcaaggtgttgagcccaatgtgtggacatatagttcaatcattgatgcattgtgcaaggccagagcaatggacaaggcagagctagtgcttcagcagatggttaacaaaggtgttcaacccgataatgtgacatataattgcatgatccatggatattccacatctgggcggtggaaagaggctgttaaattgtttagagaaatgaaaagccggggccttataccagataattttacttgcaactccttaatgacttacctttgtaagcatggaagaagcaaagaaggtgcagaattttttgatgccatgactgccaaagggcacagagatgtcatctcctactatattttgcttcatgggtatgccaatgaaggatgctttgctgatatgattgatctctttaattcaatggaaagaaacggtattgctgccaactgccgtgttttcaacatattaattaatggacatgctaaacgtggaatgacggatgaagctatgctgatatttacagaaatgtgggaaaaaggagtgagtcccaatgtagtcacatattccactgtaatagctgcactttccaggatgggtaggttgactgattctatggaaaaatttaatcagatgattgccatgggaattcagccaaacacagctgtttatcactccctaattcagggttgttttatgcatggtggcttggttaaagctaaggagctgatgtttgaaatgatgaacaaaggtattcctcgtcctaacattgttttcttcagttcagtaataaacagtctgtgcaaagaaggaagggttatggatgcacatgctgtctttgacttggctataggcatcggtgagaggcctaatgtcattacatttaattcactgattgacggatattgcttagttgggaagatggataaagcattcaaaatacttcatgtcatggaatcagttggtgttgagtctgatgttgttacttatagcgcacttcttgatggctattttaaaaacagaaggattgatgatgctttgactttgtttagagaaatgccgcgcaagagaattaaacctaacactgttacatatggcatcatgttgggtgggttgtttcatgctgggagaactgttgctgcaatgaaaatgttccatgagatgattgaaagtggagcaacagtgcgcatttccacatacaatataatacttggaggtctttgtcaaactaattgtgtagacgaagcgattgcactgttccagaaattgcgagcaatgaatgtgaagttcaatattgaaatattcaataccatgattgatgcaatgtacaaggttcaaagaaaagaagaagctaaggaattgtttgctgcaatatcaggcaatgggttggtgcccaatgaatatacttatgcagtaatgataagaaatcttctaaaaggcggagcagtggaagatgctgacaatatgttttcatcaatggacaacagtggcatcgttcctagttcccgtcttataaatgatatcatcagaatgttgttggaaaaaggtgagatagccaaggctggcaattatttgtctaaagttgatgggaagagtatctcacttgaagcttcaactacctcattgatgttgtctctcttttcaaggaaagggaaacatctggaggatattaagttgctccctgcaaagtatcaattttttgatggatttggt

SEQ ID NO: 1577 - DNA, 2640 bp, Triticum aestivum
atgctccgccgcatccgcatctccactcctgtcatcggaggaaaaaaagctcccgtacgaactcccgacgccgatgctccgcggcatccgcacccgcctccgtcgccgcccctccccctcctgcacctagccggcgtccgttctccgcctccctctccgccactcgtccgcctccaccagtaccgcaccaccagcacgccgatgtcccgcatccacctccacctccaccaacaccgccgcctcttctcctccacctcgccgccctcgcgctcctggtctccccacgaagcctttgccgcggccacagagcgcgtccgcgccgggaatttcagctgggaagacgcacacaacctgttcgacgaattgctgcggcaggccaccccggtccccgggcgctccctcaacggcttccttgccgccctcgcccgtgcgcccgcctccgaagcctgcagagatggtcccgccctcgccctcgctctcttcaaccacgtctgccgggacgaatccggcgcgcgggtggcaccgcccacaatcttcacgtacggcattctcatgaactgctgctgtcgtgcgcatcgcccggacctagggctagccttcttcggtcgcctcctcaggacgggcctgaaggctgacctgatcgtcgccaacaccctccttaagtgtctctgccgcgcgaaacggacggatgaggctgtgaacgtgctgcttcataggatgtctgagctcggctgtgtgcctgatgccttctcatactccattgttctcaagagcttatgcgacaatggcatgagtcagcaggcgctcaacctgctccatatgatggcgaaagtaggaggtggctgctcccccgacgtggtggcgtatagcacagtcatccatggcttctttaaggaaggtgaaacaggcaaggcatgcaatctgttccatgaaatgatgcagcaaggtgttgagcccaatgtgtggacatatagttcaatcattgatgcattgtgcaaggccagagcaatggacaaggcagagctagtgcttcagcagatggttaacaaaggtgttcaacccgataatgtgacatataattgcatgatccatggatattccacatctgggcggtggaaagaggctgttaaattgtttagagaaatgaaaagccggggccttataccagataattttacttgcaactccttaatgacttacctttgtaagcatggaagaagcaaagaaggtgcagaattttttgatgccatgactgccaaagggcacagagatgtcatctcctactatattttgcttcatgggtatgccaatgaagaatgctttgctgatatgattgatctctttaattcaatggaaagaaacggtattgctgccaactgccgtgttttcaacatattaattaatggatatgctaaacgtggaatgacggatgaagctatgctgatatttacagaaatgtgggaaaaaggagtgagtcccaatgtagtcacatattccactgtaatagctgcactttccaggatgggtaggttgactgattctatggaaaaatttaatcagatgattgccatgggaattcagccaaacacagctgtttatcactccctaattcagggttgttttatgcatggtggcttggttaaagctaaggagctgatgtttgaaatgatgaacaaaggtattcctcgtcctaacattgttttcttcagttcagtaataaacagtctgtgcaaagaaggaagggttatggatgcacatgctgtctttgacttggctataggcatcggtgagaggcctaatgtcattacatttaattcactgattgacggatattgcttagttgggaagatggataaagcattcaaaatacttcatgtcatggaatcagttggtgttgagtctgatgttgttacttatagcgcacttcttgatggctattttaaaaacagaaggattgatgatgctttgactttgtttagagaaatgccgcgcaagagaattaaacctaacactgttacatatggcatcatgttgggtgggttgtttcatgctgggagaactgttgctgcaatgaaaatgttccatgagatgattgaaagtggagcaacagtgcgcatttccacatacaatataatacttggaggtctttgtcaaactaattgtgtagacgaagcgattgcactgttccagaaattgcgagcaatgaatgtgaagttcaatattgaaatattcaataccatgattgatgcaatgtacaaggttcaaagaaaagaagaagctaaggaattgtttgctgcaatatcaggcaatgggttggtgcccaatgaatatacttatgcagtaatgataagaaatcttctaaaaggcggagcagtggaagatgctgacaatatgttttcatcaatggacaacagtggcatcgttcctagttcccgtcttataaatgatatcatcagaatgttgttggaaaaaggtgagatagccaaggctggcaattatttgtctaaagttgatgggaagagtatctcacttgaagcttcaactacctcattgatgttgtctctcttttcaaggaaagggaaacatctggaggatattaagttgctccctgcaaagtatcaattttttgatggatttggt

SEQ ID NO: 1578 - DNA, 2640 bp, Triticum aestivum; identical to SEQ ID NO: 1577

SEQ ID NO: 1579 - DNA, 2640 bp, Triticum aestivum; identical to SEQ ID NO: 1577

SEQ ID NO: 1580 - DNA, 2640 bp, Triticum aestivum; identical to SEQ ID NO: 1577

SEQ ID NO: 1581 - DNA, 2640 bp, Triticum aestivum; identical to SEQ ID NO: 1576

SEQ ID NO: 1582 - DNA, 2631 bp, Triticum aestivum
atgctccgccgcatccgcatctccactcctgtagctcccgtacggactcccgacgccgatgctccgcggcatccacacccgcctccgttgccgcccctccccctcctgcacctagccggagtccgttctccgcctccctctccgccactcgtccgcctccaccagtaccgcaccaccagcacgccgatgtcccgcatccacctccacctccacctccaccaacaccgccgcctcttctcctccacctcgccgccctcgcgctcctggtctccccacgaagcctttgccgcggccacagagcgcgtccgcgccgggaatttcagctgggaagacgcacacaacctgttcgacgaattgctgcggcaggccaccccggtccccgggcgctccctcaacggcttccttgccgccctcgcccgtgcgcccgcctccgaagcctgcagagatggccctgccctcgccctcgctctcttcaaccacgtctgccgggacgaatccggcgcgcgggtggcaccgcccacaatcttcacgtacggcattctcatgaactgctgctgtcgtgcgcatcgcccggacctagggctagccttcttcggtcgtctcctcaggacgggcctgaaggctgacctgatcgtcgccaacaccctccttaagtgtctctgccgcgcgaaacggacggatgaggctgtgaacgtgctgcttcataggatgtccgagctcggctgtgtgcctaatgccttctcatactccattgttctcaagagcttatgcgacaatggcatgagtcagcaggcactcgacctgctccatatgatggcgaaagaaggaggtgactgctcccccgacgtggtggcgtatagcacagtcatccatggcttctttaaggaaggtgaaacaggcaaggcatgcaatctgttccatgaaatgatgcagcaaggtgttgagcccaatgtgtggacatatagttcaatcattgatgcattgtgcaaggccagagcaatggacaaggcagagctagtgcttcagcagatggttaacaaaggtgttcaacccgataatgtgacatataattgcatgatccatggatattccacatctgggcggtggaaagaggctgttaaattgtttagagaaatgaaaagccggggccttataccagataattttacttgcaactccttaatgacttacctttgtaagcatggaagaagcaaagaaggtgcagaattttttgatgctatgactgccaaagggcacagagatgtcatctcctactgtattttgcttcatgggtatgccaatgaaggatgctttgctgatatgattgatctctttaattcaatggaaagaaacggtattgctgccaactgccgtgttttcaacatattaattaatggatatgctaaacgtggaatgacggaagaagctatgctgatatttacagaaatgtgggaaaaaggagtgagtcccaatgtagtcacatattccactgtaatagctgcactttccaggatgggtaggttgactgattctatggacaaatttaatcagatgattgccatgggaattcagccaaacacagctgtttatcactccctaattcagggttgttttatgcatggtggcttggttaaagctaaggagctgatgtttgaaatgatgaacaaaggtattcctcgtcctaacattgttttcttcagttcagtaataaacagtctgtgcaaagaaggaagggttatggatgcacatgctgtctttgacttggctataggcataggtgagaggcctaatgtcattacatttaattcactgattgacggatattgcttagttgggaagatggataaagcattcaaaatacttcttgtcatggaatcagttggtgttgagcctgatgttgttacttatagtgcacttcttgatggctattttaaaaacagaagcattgatgatgctttgactttttttagagaaatgccgcgcaagagaattaaacctaacactgttacatatggcatcatgttgggtgggttgtttcgtgctgggagaactgttgctgcaatgaaaatgttccatgagatgattgaaagtggagcaacagtgcgcatttccacatacaatataatacttggaggtctttgtcaaactaattgtgtagacgaagcgattgcactgttccagaaattgcgagcaatgaatgtgaagttcaatattgaaatattcaataccatgattgatgcaatgtacaaggttcaaagaaaagaagaagctaaggaattgtttgctgcaatatcaggcaatgggttggtgcccaatgaatatacttatgcagtaatgataagaaatcttctaaaaggcggagcagtggaagatgctgacaatatgttttcatcaatggacaacagtggcatcgttcctagttcccgtcttataaatgatatcatcagaatgttgttggaaaaaggtgagatagccaaggctggcaattatttgtctaaagttgatgggaagagtatctcacttgaagcttcaactacctcattgatgttgtctctcttttcaaggaaagggaaacatctggaggatattaagttgctccctgcaaagtatcaattttttgatggatttggt

SEQ ID NO: 1583 - DNA, 1101 bp, Triticum aestivum
atggctgcaaagggcctgaaacctaatatcgtctcctactctactatgcttaatgggtatgtcaaagaaggatccttcgaggatatgactgatctcttcaattcgatggtacggaatggtattgtacctaaccaccatattttcaacatacagatcaatgcatatgctaaacgtggactgatggatgaggctatgcacatgttcgaagtaatgaggcaacaaggagtaaacccaaacgtagttgactatctagtagtaatgaattcactctgcaaaatgggtaggatggatgctgctctggacaaatttaatcagatggtcaatcaaggagtttcacctaacaaagctgtttaccaatgcctggttctgggttcttgctctcatggtcattttgtgaaagccaaggaattgatttctgaagcggttaatagaggtctgtgttctaacagtgtgttcttctatcctgtaataaacgacctttgcaaggaaggaaaggtagaaggaaaggtgaaggaggcacaggatatgtttgacttcattgtaggtattggtcatcggcctgatgtgattatgtacacttcactgatggatggatattgccttgttggcaaggtggaggaagcactgagagtacttgatgctatgaagtctgctggcctccaacctgatgcttttacatatggtatacttattaatggctactgtaaaattggaaggatcgacgagggattgagtcttgtcagggaaatttcactcagtggggttaagcccacgactattatgtacaacattatacttgatgggctgttttgctctgggagaacagttcctgcaaaggaaaaattccataagatgaatgaaagtgccataccagtgggcgttggaacatacaacatagttcttagtggactttgtaaaaataattgcactgatgaagcaatagagctgttcaagaaattacgtgctgtgaacgtgaagattaatgtcataacactcactaccatgatttctgcaatgttttcacaaaagaatggatccacgctcgccttacatcttctctcttccttttgccatctcattttgtttgctcaactaaacata

SEQ ID NO: 1584 - DNA, 1101 bp, Triticum aestivum; identical to SEQ ID NO: 1583

SEQ ID NO: 1585 - DNA, 1101 bp, Triticum aestivum
atggctgcaaagggcctgaaacctaatatcgtctcctactctactatgcttaatgggtatgtcaaagaaggatccttcgaggatatgactgatctcttcaattcgatggtacggaatggtattgtacctaaccaccatattttcaacatacagatcaatgcatatgctgaacgtggactgatggatgaggctatgcacatgttcgaagtaatgaggcaacaaggagtaaacccaaacgtagttgactatctagtagtaatgaattcactctgcaaaatgggtaggatggatgctgctctggacaaatttaatcagatggtcaatcaaggagtttcacctaacaaagctgtttaccaatgcctggttctgggttcttgctctcatggtcattttgtgaaagccaaggaattgatttctgaagcggttaatagaggtctgtgttctaacagtgtgttcttctatcctgtaataaacgacctttgcaaagaaggaaaggtagaaggaaaggtgaaggaggcacaggatatgtttgacttcattgtaggtattggtcatcggcctgatgtgattatgtacacttcactgatggatggatattgccttgttggcaaggtggaggaagcactgagagtacttgatgctatgaagtctgctggcctccaacctgatgcttttacatatggtatacttattaatggctactgtaaaattggaaggatcgacgagggattgagtcttgtcagggaaatttcactcagtggggttaagcccacgactattatgtacaacattatacttgatgggctgttttgctctgggagaacagttcctgcaaaggaaaaattccataagatgaatgaaagtgccataccagtgggcgttggaacatacaacatagttcttagtggactttgtaaaaataattgcactgatgaagcaatagagctgttcaagaaattacgtgctgtgaacgtgaagattaatgtcataacactcactaccatgatttctgcaatgttttcacaaaagaatggatccacgctcgccttacatcttctctcttccttttgccatctcattttgtttgctcaactaaacata

SEQ ID NO: 1586 - DNA, 651 bp, Triticum aestivum
atgcgctggtcgcccacactctgtacctattccatcctcatgtactgctgctgccgtgcaggccgcccggacttggtggttgccttcttcggccgcatcctcaggttggggctgcgcttggacgtcatctccttaaacaatctcctcaaggggctttgccaggctaagcgctcaaatgaggcattggatctgctgctccaccggatgcccgaactacactgtgcgcctgatgtcttctcgtacaacatagtaatcaacggctgcttgaaagaaggtgaagtagacaaagcgtgcaatctcttccatgagatgccccaactgggagttcaacctgatgtggtgacctacacctcaatcatggacgcactaagcaagtccggagcaatggacaaggcagaagtgctccttcggcaaatggttgatcaaggaattgaacccaatatcaggacatatagctgtctgatccatggatattctacttttggtcagtggaaggaggcacttagggtattcaaagaaatggcaactcttggtgttgtaccagacgttgtcacgttgagctcattaatcgattccctttgcaagcacagaaggacaaaggaagctagagaaatttttgactctatatatggctgcaaagggcctgaaacc

SEQ ID NO: 1587 - DNA, 2319 bp, Triticum aestivum
atgtcaaccgcccgcctgtcctccaccttcacctcctccttcaaggctccttcacggaaaccacgagccccccgcctcgccgccttggctgccgccacggagcgcgtccgcgccggaacgctaagtcggcaggacgcgcaccacctgttcgacgaattgctgagccaagccgcgacagtcccagtacgcacgctcaacaattttcttgccgccctcgcccgtgctccgccctcagctgcctgtggcgatggccctgcccttgccgtcaccctcttcaaccgcatgtcccgaggcgctggtgcacgggtggtgtcgcccacgctctgtacctattccatcctcatggactgctgctgccgcgcaggccgcccggacttggtggttgccttcttcggccgcctcctcaggttggggctgcgcttggaggtcatctccttcagcaatctccttaaggggctctgccaggccaagcgtacaaatgaggcggtggacttgctgctccaccggacacctgaactggactgtgtgcctaatgtcttctcgtacagcatcgtaatcaacggctgttttaaagaaggtgaagtagacaaagcgtgcaatctcttccatgggatgatccaactgggagttcaacctaatgtggtcatctacacctcaattatcgatgcactaagcaagtgcggagccatggacaaggcagaagtggtctttcggcaaatggttgataaaggtattggacccgatgtcatgacatgcactagtctgatccatggatattccatttcgggtaggtggaaggcggcagtaagggtattcaaagagatgataagtcttggtgttgtaccagataccgtcatgtggaactcatttgtggattcactttgcaagcatagaaggacaaaggaagctagagttatttttgactccatggctgcaaagggccagaaacctgatactgtctcctactctattatgcttaacgggtatgtgaaagaaggatgctttgatgatatgaccggtctcttcaattcgatgctacagaacggtgttgtacctaaccaccatattttcaacatactgatcaatgcatatgctaaacgtggactgatggatgaggctatgcacatgttcgaagtaatgaggcaacaaggagtaaacccagatgtagttgactatctagtagtaatggattcactttgcaaaatgggtaggatggatgctgctctggacaaatttaatcagatggtcaatcaaggagtttcacctaacaaagctgtttaccaatgcctggttctgggtttttgctctcatggcgattttgtgaaagccaaggaattgatctctgaaacaattaatagaggtctgtgttctaacaatgtgttcttctatcctgtaataaacgacctgtgcaaagaaggaaaggtgaaggaggcacaggatatgtttgacttcattgtaggtattggtcagcggcccgatgtgattatgtacaattcactgatggatggatattgccttgttggcaaggtggaggaagcactgagagtacttgatgctatgaagtctgctggcctccaacctgatgctattacgtatgctatacttcttaatggctactgtaaaattggcaggatcgccgatggattgagtcttttcagggaaatgtcactcagcggggttaagcccacgactattatgtacagcattatacttgatgggctgtttcgctccgggagaacagtttctgcaaaggaaaaattcaatacgatggttgaaagtggcttaccagtggacgttcgcacatacaacatagttcttcatggactttgtagaaacaattgcactggtgaagcaatagagttgttcaaaaaattatgtgcaacgaacttgaagattaatgtcataacattcaataccatgatttctgcaatgtttaaaactaggagaattggagaagccaaggatttgtttgctactatatcagccatcgggttggtgccttctgttgtgacttacagtgtaatgacgacgaatttcataaaagaagggttgctggcggaggctgatgatatgtttttagcaatggagaaggctggctgtgctcctgactccagactgctaaatcacgtggtcagcgtgttgctggagaatggtgcagttgtaaaggctgcaacttatctcgctaaacttgatgcaaaacagctttcacttgaagcttcgacagtttcgttaattgtatctctcttctcaaggaaagggaaattaagggagcatgtaaagttgcttccggtaaagtaccagcctcctgagatgttgggc

SEQ ID NO: 1588 - DNA, 2319 bp, Triticum aestivum
atgtcaaccgcccgcctgtcctccaccttcacctcctccttcaaggctccttcacggaaaccacgagccccccgcctcgccgccttggctgccgccacggagcgcgtccgcgccggaacgctaagtcggcaggacgcgcaccacctgttcgacgaattgctgagccaagccgcgacagtcccagtacgcacgctcaacaattttcttgccgccctcgcccgtgctccgccctcagctgcctgtggcgatggccctgcccttgccgtcaccctcttcaaccgcatgtcccgaggcgctggtgcacgggtggtgtcgcccacgctctgtacctattccatcctcatggactgctgctgccgcgcaggccgcccggacttggtggttgccttcttcggccgcctcctcaggttggggctgcgcttggaggtcatctccttcagcaatctccttaaggggctctgccaggccaagcgtacaaatgaggcggtggacttgctgctccaccggacacctgaactggactgtgtgcctaatgtcttctcgtacagcatcgtaatcaacggctgttttaaagaaggtgaagtagacaaagcgtgcaatctcttccatgggatgatccaactgggagttcaacctaatgtggtcatctacacctcaattatcgatgcactaagcaagtgcggagccatggacaaggcagaagtggtctttcggcaaatggttgataaaggtattggacccgatgtcatgacatgcactagtctgatccatggatattccatttcgggtaggtggaaggcggcagtaagggtattcaaagagatgataagtcttggtgttgtaccagataccgtcatgtggaactcatttgtggattcactttgcaagcatagaaggacaaaggaagctagagttatttttgactccatggctgcaaagggccagaaacctgatactgtctcctactctattatgcttaacgggtatgtgaaagaaggatgctttgatgatatgaccggtctcttcaattcgatgctacagaacggtgttgtacctaaccaccatattttcaacatactgatcaatgcatatgctaaacgtggactgatggatgaggctatgcacatgttcgaagtaatgaggcaacaaggagtaaacccagatgtagttgactatctagtagtaatggattcactttgcaaaatgggtaggatggatgctgctctggacaaatttaatcagatggtcaatcaaggagtttcacctaacaaagctgtttaccaatgcctggttctgggtttttgctctcatggcgattttgtgaaagccaaggaattgatctctgaaacaattaatagaggtctgtgttctaacaatgtgttcttctatcctgtaataaacgacctgtgcaaagaaggaaaggtgaaggaggcacaggatatgtttgacttcattgtaggtattggtcagcggcccgatgtgattatgtacaattcactgatggatggatattgccttgttggcaaggtggaggaagcactgagagtacttgatgctatgaagtctgctggcctccaacctgatgctattacgtatgctatacttcttaatggctactgtaaaattggcaggatcgccgatggattgagtcttttcagggaaatgtcactcagcggggttaagcccacgactattatgtacagcattatacttgatgggctgtttcgctccgggagaacagtttctgcaaaggaaaaattcaatacgatggttgaaagtggcttaccagtggacgttcgcacatacaacatagttcttcatggactttgtagaaacaattgcactggtgaagcaatagagttgttcaaaaaattatgtgcaacgaacgtgaagattaatgtcataacattcaataccatgatttctgcaatgtttaaaactaggagaattggagaagccaaggatttgtttgctactatatcagccatcgggttggtgccttctgttgtgacttacagtgtaatgacgacgaatttcataaaagaagggttgctggcggaggctgatgatatgtttttagcaatggagaaggctggctgtgctcccaactccaggctgctaaatcacgtggtcagagtgttgctggagaatggtgcagttgtaaaggctgcaacttatctcgctaaacttgatgcaaaacagctttcacttgaagcttcgacagtttcgttaattgtatctctcttctcaaggaaagggaaattaagggagcatgtaaagttgcttccggtaaagtaccagcctcctgagatgttggac

SEQ ID NO: 1589 - DNA, 1617 bp, Triticum aestivum
atgtcaaccgcccgcctgtcctccaccttcacctcctccttcaaggctccttcacggaaaccacgagccccccgcctcgccgccttggctgccgccacggagcgcgtccgcgccggaacgctaagtcggcaggacgcgcaccacctgttcgacgaattgctgagccaagccgcgacagtcccagtacgcacgctcaacaattttcttgccgccctcgcccgtgctccgccctcagctgcctgtggcgatggccctgcccttgccgtcaccctcttcaaccgcatgtcccgaggcgctggtgcacgggtggtgtcgcccacgctctgtacctattccatcctcatggactgctgctgccgcgcaggccgcccggacttggtggttgccttcttcggccgcctcctcaggttggggctgcgcttggaggtcatctccttcagcaatctccttaaggggctctgccaggccaagcgtacaaatgaggcggtggacttgctgctccaccggacacctgaactggactgtgtgcctaatgtcttctcgtacagcatcgtaatcaacggctgttttaaagaaggtgaagtagacaaagcgtgcaatctcttccatgggatgatccaactgggagttcaacctaatgtggtcatctacacctcaattatcgatgcactaagcaagtgcggagccatggacaaggcagaagtggtctttcggcaaatggttgataaaggtattggacccgatgtcatgacatgcactagtctgatccatggatattccatttcgggtaggtggaaggcggcagtaagggtattcaaagagatgataagtcttggtgttgtaccagataccgtcatgtggaactcatttgtggattcactttgcaagcatagaaggacaaaggaagctagagttatttttgactccatggctgcaaagggccagaaacctgatactgtctcctactctattatgcttaacgggtatgtgaaagaaggatgctttgatgatatgaccggtctcttcaattcgatgctacagaacggtgttgtacctaaccaccatattttcaacatactgatcaatgcatatgctaaacgtggactgatggatgaggctatgcacatgttcgaagtaatgaggcaacaaggagtaaacccagatgtagttgactatctagtagtaatggattcactttgcaaaatgggtaggatggatgctgctctggacaaatttaatcagatggtcaatcaaggagtttcacctaacaaagctgtttaccaatgcctggttctgggttcttgctctcatggtgattttgtgaaagccaaggaattgatttctgaagcacttaatagaggtctctgttctaacagtgtgttcttctatcctgtaataaacgacctgtgcaaagaaggaaaggtgaaggaggcacaggatatgtttgacttcattgtaggtattggtcagcggcccgatgtgattatgtacaattcactgatggatggatattgccttgttggcaaggtggaggaagcactgagagtacttgatgctatgaagtctgctggcctccaacctgatgctattatgtatggtatacttcttaatgatcac

SEQ ID NO: 1590 - DNA, 2319 bp, Triticum aestivum; identical to SEQ ID NO: 1587

SEQ ID NO: 1591 - DNA, 2319 bp, Triticum aestivum; identical to SEQ ID NO: 1588

SEQ ID NO: 1592 - DNA, 2319 bp, Triticum aestivum; identical to SEQ ID NO: 1588

SEQ ID NO: 1593 - DNA, 2361 bp, Triticum aestivum
atgcctcgcttctcctcaaccacgccaatggcgccaccccgcctcctcctccgactcggcgcccgccactcctcctccacctctcatccctcacgcatctgggatccccacgccgccttcgccgccgccgcagaccgcgcgcgctctggcaacctcaccccggaggacgcacaccacctgttcgacgaattgctgcggcagggcaatcctgtccaggagcgtcccttgaataactttctggctgccctcgcccgcgcgcccgcgtctgcatcctgcagtgattgccccgccctggccgttgccctcttcggccgtttgtcccgaggcgccggacgacgggtggtgcagccaaatgtgttcacctatggcgtcctcatggactgctgctgccgcgcgtgccgcacggatctggcgctcgccttcttcggccgtctcctcaagacgggcctggaggcagaccaagtcgtcttcagcaccctcctgaagggcctttgccacgcaaagcgggcagatgaggctctggacgtgctgcttgacaggatgcctgagctgggctgcacccctgacgtggtggcgtataccacggtcatccatggcttctttagggaaggccaagtaggcaaggcgtgcgatctgttccatgaaatggcgcagcagggcgttacacctgatgtggtgacatatagctcggttattgatgcgctgtgcaaggccaaagcaatggacaaggcagagtatttccttggtcagatggttgatagtggtgtcgtacctaataatgtgacatataatagcctcatccatggatattcctcttcaggccattcaaaggaggcggtcagggtgctgaaaaaaatgacaagtcagggtattataccagatgtttttacttgcaactcgctcatggcctccctttgcaacaacagaaaaagcaaagaagctgcagaaatttttcactccatggccatgaagggcctgaaacctgatatcgtctcgtacagtactctgcttcacgggtatgccaccgaaggatgcttagttgatatgactaatctctttaattcaatgactagagatggtattctccctaactgtcatgctttgaacatactgattaatgcatatgcgaaatctggcatgatggatgaggccatgcttatatttaaaggaatgcggaaacaaggagtgagtccagatgcagtcacatatgcaaccgtaatacatgcattctgcagaaatggtaggttggacgatgctgtgataaagtttaatcagatgattgatacaggagtacgaccggacacggctgtttatggttctctaatccagggtttttgtacacatggcgatttggtgaaatcaaaggaattggttactgaaatgatgaacaaaggtatacctcgtcctgatattaagttcttccattcaatcatgcaaaacctatgcacagaaggaagggtaatagaagcacgggatatccttggcttgatagcacacattggtatgaggcctaatgttgtcacatttagtgtactgatcggtggatactgcctagtccgcaagatggcagatgcatcgaaagtatttgatgatatggtgtcatatggtttagaaccgtctaatattacatatggtatacttattaatggctattgcaaaaacaaaaggattgacgatgggctgattctattcaaaacaatgttgcacaagggacttaaacctacaacttttaattataacgtcatactggatggattatttctggctggacgaacagttgctgcaaaagagaagtttaatgagatggttgaatctggagtaagtgtgtgcattggcacatgctctatagttcttggtggactttgtagaaatggctgcagtagcgaagcgatcaccctgttccgaaaattaagcgcaatgaatgtgaaatttgatattacaattgtcaataccattattggtgccttctacagggtcgagagaaaccaagaggctaaggatttgtttgctgctattccagccaatggcttggttcctaattctattacctacaccataatgatgacaaatcttataaaagaaggttcagtggaagaagctgacaatctttttttatcgatggagaatagcggctgtagtgccaactcttatctgttaaatcatgtcatcagaaggttactgcaaaaaggagagatagtcaaggctggaaattatatgtctaaagttgatgcaaagagcttttcacttgaagctaaaactgtttcactgctgatctctctgttttcaaggaaagggaaatatagagaacacatcaaattgctgcctacaaagtatcagtttctggaagaagccacagttgaa

SEQ ID NO: 1594 - DNA, 2361 bp, Triticum aestivum
atgcctcgcttctcctcaaccacgccaatggcgccaccccgcctcctcctccgactcggcgcccgccactcctcctccacctctcatccctcacgcatctgggatccccacgccgccttcgccgccgccgcagaccgcgcgcgctctggcaacctcaccccggaggacgcacaccacctgttcgacgaattgctgcggcagggcaatcctgtccaggagcgtcccttgaataactttctggctgccctcgcccgcgcgcccgcgtctgcatcctgcagtgattgccccgccctggccgttgccctcttcggccgtttgtcccgaggcgccggacgacgggtggtgcagccaaatgtgttcacctatggcgtcctcatggactgctgctgccgcgcgtgccgcacggatctggcgctcgccttcttcggccgtctcctcaagacgggcctggaggcagaccaagtcgtcttcagcaccctcctgaagggcctttgccacgcaaagcgggcagatgaggctctggacgtgctgcttgacaggatgcctgagctgggctgcacccctgacgtggtggcgtataccacggtcatccatggcttctttagggaaggccaagtaggcaaggcgtgcgatctgttccatgaaatggcgcagcagggcgttacacctgatgtggtgacatatagctcggttattgatgcgctgtgcaaggccaaagcaatggacaaggcagagtatttccttggtcagatggttgatagtggtgtcgtacctaataatgtgacatataatagcctcatccatggatattcctcttcaggccattcaaaggaggcggtcagggtgctgaaaaaaatgacaagtcagggtattataccagatgtttttacttgcaactcgctcatggcctccctttgcaacaacagaaaaagcaaagaagctgcagaaatttttcactccatggccatgaagggcctgaaacctgatatcgtctcgtacagtactctgcttcacgggtatgccaccgaaggatgcttagttgatatgactaatctctttaattcaatgactagagatggtattctccctaactgtcatgctttgaacatactgattaatgcatatgcgaaatctggcatgatggatgaggccatgcttatatttaaaggaatgcggaaacaaggagtgagtccagatgcagtcacatatgcaaccgtaatacatgcattctgcagaaatggtaggttggacgatgctgtgataaagtttaatcagatgattgatacaggagtacgaccggacacggctgtttatggttctctaatccagggtttttgtacacatggcgatttggtgaaatcaaaggaattggttactgaaatgatgaacaaaggtatacctcgtcctgatattaagttcttccattcaatcatgcaaaacctatgcacagaaggaagggtaatagaagcacgggatatccttggcttgatagcacacattggtatgaggcctaatgttgtcacatttagtgtactgatcggtggatactgcctagtccgcaagatggcagatgcatcgaaagtatttgatgatatggtgtcatatggtttagaaccgtctaatattacatatggtatacttattaatggctattgcaaaaacaaaaggattgacgatgggctgattctattcaaaacaatgttgcacaagggacttaaacctacaacttttaattataacgtcatactggatggattatttctggctggacgaacagttgctgcaaaagagaagtttaatgagatggttgaatctggagtaagtgtgtgcattggcacatgctctatagttcttggtggactttgtagaaatggctgcagtagcgaagcgatcaccctgttccgaaaattaagcgcaatgaatgtgaaatttgatattacaattgtcaataccattattggtgccttctacagggtcgagagaaaccaagaggctaaggatttgtttgctgctattccagccaatggcttggttcctaattctgttacctacaccataatgatgacaaatcttataaaagaaggttcagtggaagaagctgacaatctttttttatcgatggagaatagcggctgtagtgccaactcttatctgttaaatcatgtcatcagaaggttactgcaaaaaggagagatagtcaaggctggaaattatatgtctaaagttgatgcaaagagcttttcacttgaagctaaaactgtttcactgctgatctctctgttttcaaggaaagggaaatatagagaacacatcaaattgctgcctacaaagtatcagtttctggaagaagccacagttgaa

SEQ ID NO: 1595 - DNA, 2361 bp, Triticum aestivum; identical to SEQ ID NO: 1594

SEQ ID NO: 1596 - DNA, 2361 bp, Triticum aestivum; identical to SEQ ID NO: 1594

SEQ ID NO: 1597 - DNA, 2361 bp, Triticum aestivum; identical to SEQ ID NO: 1594

SEQ ID NO: 1598 - DNA, 2361 bp, Triticum aestivum; identical to SEQ ID NO: 1594

SEQ ID NO: 1599 - DNA, 2040 bp, Triticum aestivum
atggcccgggccttgccatcgccctcttcaaccgcatgtcccgaggcgctggtgcacgggtggtgtcgctgccgtgcaggccgcccggacttggtggttgccttctttggccgcctcctcagattggggctgtgcttgaatgtcatctccttgagcaacctcctcaaggggctctgccaggtcaagcgtacaaatgaggctgtggacttgctgctccaccggacacctgaactggactgtgtgcctaatgtcttctcgtacagcatcgtaatcaacggctgttttaaacaaggtgaagtagacaaagcgtgcaatctcttccatgggatgatccaactgggagttcaacctaatgtggtcatctacacctcaattatcgatgcactaagcaagtgcggagtcatggacaaggcagaagtggtctttcggcaaatggttgataaaggtattggacccgatgtcatgacatgcactagtctgatccatggatattccatttcgggtaggtggaaggcggcagtaagggtattcaaagagatgataagtcttggtgttgtaccagataccgtcatgtggaactcatttgtggattcactttgcaagcatagaaggacaaaggaagctagagttatttttgactccatggctgcaaagggccagaaacctgatactgtctcctactctattatgcttaacgggtatgtgaaagaaggatgctttgatgatatgaccggtctcttcaattcgatgctacagaacggtgttgtacctaaccaccatattttcaacatactgatcaatgcatatgctaaacgtggactgatggatgaggctatgcacatgtttgaagtaatgaggcaacaaggagtaaacccagatgtagttgactatcaaattgtaatggattcactttgcaaaatgggtaggatggatgctgctctggacaaatttaatcagatggtcaatcaaggagtttcacctgacaaagctgtttaccgatgcctggttctgggttcttgctctcatggtgattttgtgaaagccaaggaattgatttctgaagcagttaatagaggtctctgttctaacagtgtgttcttctatcctgtaataaacgacctgtgcaaagaaggaaaggtgaaggaggcacaggatatgtttgacttcattgtaggtattggtcagcggcccgatgtgattatgtacaattcactgatggatggatattgccttgttggcaaggtggaggaagcactgagagtacttgatgctatgaagtctgctggcctccaacctgatgctattacgtatgctatacttcttaatggctactgtaaaattggcaggatcgccgatggattgagtcttttcagggaaatgtcactcctcggggttaagcccacgactattatgtacaacattatacttgatgggctgtttcgctccgggagaacagtttctgcaaaggaaaaattccgtacgatgagcgaaagtggcataccagtgggcgttgacacatacaacatagttcttcatggactttgtagaaacaattgcactgatgaagcaatagagctgttcaacaaattacgtgctatgaaattgaagattaatgtcataacactcaataccatgatttctgcaatgtttaaaactaggagaattgaagaagccaaggatttgtttgctactatatcagccattgggttggtgccttctgttgtgacttacagtgtaatgatgacgaatttcataaaagaagggttgttggcagaggctgatgatatgtttttagcaatggagaaggctagctgtgctcccgactccattctgctaaatcaagtggtcagggcgttgctggaaaaaggtgcagttgtgaaggctgcaacttatctcgctaaacttgatgctaaacagctgtcagttgaagcttcaacgatttccttaatagtatctctcttctcaggggaagggaaattaagggagcacgtacagttgcttccggtaaagtaccagcctcctgagagttcggctgacaat

SEQ ID NO: 1600 - DNA, 2334 bp, Triticum aestivum
atgccgaccggccggctgtcctccatcttcaccagcaatgcaacctcctccttcagggctccttcgccacagccacgagcccccctcgccgccttggctgccgccacggagcgcgtccgcgccggaacgctaagtcggcaggacgcgcaccacctgttcgacgaattgctgagccaagccgcgacagtcccagtacgcacgctcaacaattttcttgccgccctcgcccgtgctccgccctcagctgcctgtggcgatggccctgcccttgccatcgccctcttcaaccgcatgtcccaaggcgctggtgcacgggtggtgtcgcccacgctctgtacctattccatcctcatggactgctgctgccgcgcaggccgcccggacttggtggttgccttcttcggccgcctcatcaggttggggctgcgcttgaatgtcatccccttcaacaacctcctcaaggggctttgcaaggccaagcgctcaaatgaggcattggatctgctgctccaccggatgcccgaactggactgtgcgcctgatgtcttctcgtacagcatagtaatcaacggctgttttaaagaaggtgaagtagacaaagcgtgcaatctcttccatgggatgatccaactgggagttcaacctaatgtggtcatctacacctcaattatcgatgcactaagcaagtgcggagccatggacaaggcagaagtggtctttcggcaaatggttgataaaggtattggacccgatgtcatgacatgcactagtctgatccatggatattccatttcgggtaggtggaaggcggcagtaagggtattcaaagagatgataagtcttggtgttgtaccagataccgtcatgtggaactcatttgtggattcactttgcaagcatagaaggacaaaggaagctagagttatttttgactccatggctgcaaagggccagaaacctgatactgtctcctactctattatgcttaacgggtatgtgaaagaaggatgctttgatgatatgaccggtctcttcaattcgatgctacagaacggtgttgtacctaaccaccatattttcaacatactgatcaatgcatatgctaaacgtggactgatggatgaggctatgcacatgtttgaagtaatgaggcaacaaggagtaaacccagatgtagttgactatcaaattgtaatggattcactttgcaaaatgggtaggatggatgctgctctggacaaatttaatcagatggtcaatcaaggagtttcacctgacaaagctgtttaccgatgcctggttctgggttcttgctctcatggtgattttgtgaaagccaaggaattgatttctgaagcagttaatagaggtctctgttctaacagtgtgttcttctatcctgtaataaacgacctgtgcaaagaaggaaaggtgaaggaggcacaggatatgtttgacttcattgtaggtattggtcagcggcccgatgtgattatgtacaattcactgatggatggatattgccttgttggcaaggtggaggaagcactgagagtacttgatgctatgaagtctgctggcctccaacctgatgctattacgtatgctatacttcttaatggctactgtaaaattggcaggatcgccgatggattgagtcttttcagggaaatgtcactcctcggggttaagcccacgactattatgtacaacattatacttgatgggctgtttcgctccgggagaacagtttctgcaaaggaaaaattccgtacgatgagcgaaagtggcataccagtgggcgttgacacatacaacatagttcttcatggactttgtagaaacaattgcactgatgaagcaatagagctgttcaacaaattacgtgctatgaaattgaagattaatgtcataacactcaataccatgatttctgcaatgtttaaaactaggagaattgaagaagccaaggatttgtttgctactatatcagccattgggttggtgccttctgttgtgacttacagtgtaatgatgacgaatttcataaaagaagggttgttggcagaggctgatgatatgtttttagcaatggagaaggctagctgtgctcccgactccattctgctaaatcaagtggtcagggcgttgctggaaaaaggtgcagttgtgaaggctgcaacttatctcgctaaacttgatgctaaacagctgtcagttgaagcttcaacgatttccttaatagtatctctcttctcaggggaagggaaattaagggagcacgtacagttgcttccggtaaagtaccagcctcctgagagttcggctgacaat

SEQ ID NO: 1601 - DNA, 2040 bp, Triticum aestivum
atggcccgggccttgccatcgccctcttcaaccgcatgtcccgaggcgctggtgcacgggtggtgtcgctgccgtgcaggccgcccggacttggtggttgccttctttggccgcctcctcagattggggctgtgcttgaatgtcatctccttgagcaacctcctcaaggggctctgccaggtcaagcgtacaaatgaggctgtggacttgctgctccaccggacacctgaactggactgtgtgcctaatgtcttctcgtacagcatcgtaatcaacggctgttttaaacaaggtgaagtagacaaagcgtgcaatctcttccatgggatgatccaactgggagttcaacctaatgtggtcatctacacctcaattatcgatgcactaagcaagtgcggagccatggacaaggcagaagtggtctttcggcaaatggttgataaaggtattggacccgatgtcatgacatgcactagtctgatccatggatattccatttcgggtaggtggaaggcggcagtaagggtattcaaagagatgataagtcttggtgttgtaccagataccgtcatgtggaactcatttgtggattcactttgcaagcatagaaggacaaaggaagctagagttatttttgactccatggctgcaaagggccagaaacctgatactgtctcctactctattatgcttaacgggtatgtgaaagaaggatgctttgatgatatgaccggtctcttcaattcgatgctacagaacggtgttgtacctaaccaccatattttcaacatactgatcaatgcatatgctaaacgtggactgatggatgaggctatgcacatgtttgaagtaatgaggcaacaaggagtaaacccagatgtagttgactatcaaattgtaatggattcactttgcaaaatgggtaggatggatgctgctctggacaaatttaatcagatggtcaatcaaggagtttcacctgacaaagctgtttaccgatgcctggttctgggttcttgctctcatggtgattttgtgaaagccaaggaattgatttctgaagcagttaatagaggtctctgttctaacagtgtgttcttctatcctgtaataaacgacctgtgcaaagaaggaaaggtgaaggaggcacaggatatgtttgacttcattgtaggtattggtcagcggcccgatgtgattatgtacaattcactgatggatggatattgccttgttggcaaggtggaggaagcactgagagtacttgatgctatgaagtctgctggcctccaacctgatgctattacgtatgctatacttcttaatggctactgtaaaattggcaggatcgccgatggattgagtcttttcagggaaatgtcactcctcggggttaagcccacgactattatgtacaacattatacttgatgggctgtttcgctccgggagaacagtttctgcaaaggaaaaattccgtacgatgagcgaaagtggcataccagtgggcgttgacacatacaacatagttcttcatggactttgtagaaacaattgcactgatgaagcaatagagctgttcaacaaattacgtgctatgaaattgaagattaatgtcataacactcaataccatgatttctgcaatgtttaaaactaggagaattgaagaagccaaggatttgtttgctactatatcagccattgggttggtgccttctgttgtgacttacagtgtaatgatgacgaatttcataaaagaagggttgttggcagaggctgatgatatgtttttagcaatggagaaggctagctgtgctcccgactccattctgctaaatcaagtggtcagggcgttgctggaaaaaggtgcagttgtgaaggctgcaacttatctcgctaaacttgatgctaaacagctgtcagttgaagcttcaacgatttccttaatagtatctctcttctcaggggaagggaaattaagggagcacgtacagttgcttccggtaaagtaccagcctcctgagagttcggctgacaat

SEQ ID NO: 1602 - DNA, 2715 bp, Triticum aestivum
atgcatcaaggcgttggatgcactgacccgagcggacggggacaaaatccacgcccgtcggcaacctctcacccctccctctccgttcacagtctagattcgtccgccgcctcccaggccgcycgccggcggccaggaccaccggagttcctgagtctcctttctctccgacggaggcacgcctcctcttcatcgccactgttgagggcatcggttgcaaccccgcggcggcggcgagcggttcccccgagtgcttggttagtgccgagcatcgcgggtgacgccactagagcgcggtgcggcggcgcacgcacggtcagccttcccggagggcaagacccgcggcagttgcgcgccgagctccgctggagacggccagcaatgccgaccggccggctgtcctccatcttcaccagcaatgcaacctcctccttcagggctccttcgccacagccacgagcccccctcgccgccttggctgccgccacggagcgcgtccgcgccggaacgctaagtcggcaggacgcgcaccacctgttcgacgaattgctgagccaagccgcgacagtcccagtacgcacgctcaacaattttcttgccgccctcgcccgtgctccgccctcagctgcctgtggcgatggccctgcccttgccatcgccctcttcaaccgcatgtcccaaggcgctggtgcacgggtggtgtcgcccacgctctgtacctattccatcctcatggactgctgctgccgcgcaggccgcccggacttggtggttgccttcttcggccgcctcatcaggttggggctgcgcttgaatgtcatccccttcaacaacctcctcaaggggctttgcaaggccaagcgctcaaatgaggcattggatctgctgctccaccggatgcccgaactggactgtgcgcctgatgtcttctcgtacagcatagtaatcaacggctgttttaaagaaggtgaagtagacaaagcgtgcaatctcttccatgggatgatccaactgggagttcaacctaatgtggtcatctacacctcaattatcgatgcactaagcaagtgcggagccatggacaaggcagaagtggtctttcggcaaatggttgataaaggtattggacccgatgtcatgacatgcactagtctgatccatggatattccatttcgggtaggtggaaggcggcagtaagggtattcaaagagatgataagtcttggtgttgtaccagataccgtcatgtggaactcatttgtggattcactttgcaagcatagaaggacaaaggaagctagagttatttttgactccatggctgcaaagggccagaaacctgatactgtctcctactctattatgcttaacgggtatgtgaaagaaggatgctttgatgatatgaccggtctcttcaattcgatgctacagaacggtgttgtacctaaccaccatattttcaacatactgatcaatgcatatgctaaacgtggactgatggatgaggctatgcacatgtttgaagtaatgaggcaacaaggagtaaacccagatgtagttgactatcaaattgtaatggattcactttgcaaaatgggtaggatggatgctgctctggacaaatttaatcagatggtcaatcaaggagtttcacctgacaaagctgtttaccgatgcctggttctgggttcttgctctcatggtgattttgtgaaagccaaggaattgatttctgaagcagttaatagaggtctctgttctaacagtgtgttcttctatcctgtaataaacgacctgtgcaaagaaggaaaggtgaaggaggcacaggatatgtttgacttcattgtaggtattggtcagcggcccgatgtgattatgtacaattcactgatggatggatattgccttgttggcaaggtggaggaagcactgagagtacttgatgctatgaagtctgctggcctccaacctgatgctattacgtatgctatacttcttaatggctactgtaaaattggcaggatcgccgatggattgagtcttttcagggaaatgtcactcctcggggttaagcccacgactattatgtacaacattatacttgatgggctgtttcgctccgggagaacagtttctgcaaaggaaaaattccgtacgatgagcgaaagtggcataccagtgggcgttgacacatacaacatagttcttcatggactttgtagaaacaattgcactgatgaagcaatagagctgttcaacaaattacgtgctatgaaattgaagattaatgtcataacactcaataccatgatttctgcaatgtttaaaactaggagaattgaagaagccaaggatttgtttgctactatatcagccattgggttggtgccttctgttgtgacttacagtgtaatgatgacgaatttcataaaagaagggttgttggcagaggctgatgatatgtttttagcaatggagaaggctagctgtgctcccgactccattctgctaaatcaagtggtcagggcgttgctggaaaaaggtgcagttgtgaaggctgcaacttatctcgctaaacttgatgctaaacagctgtcagttgaagcttcaacgatttccttaatagtatctctcttctcaggggaagggaaattaagggagcacgtacagttgcttccggtaaagtaccagcctcctgagagttcggctgacaat

SEQ ID NO: 1603 - DNA, 2040 bp, Triticum aestivum; identical to SEQ ID NO: 1599

SEQ ID NO: 1604 - DNA, 2334 bp, Triticum aestivum; identical to SEQ ID NO: 1600

SEQ ID NO: 1605 - DNA, 1197 bp, Triticum aestivum
atgcacaaggcagagttgttccttcggcagatggttcataacggtgttcgaccggatgaggtgacatatactagcatgatccatggatattccactttgggccggctgaaagaggtgcgtaaaattttcagagaaatgacaagccgtggtcttataccagatattgtcacttggaactcgttcatggactccctttgcaagcatggaagaaccaaagaagctgcaaaggttttcttttccatggctgcaaagggcaacaagcctaatattgtctcctacactattcttcttcatgggtatgccaatgaaggaagctttgctgatatgatgagtctcttcaattcaatgaaaggcggtggcattgtagccaactgcaaagttttcaacatattaattggtgcatatgctaaacgagggctgatagatgaagctatgctcatacttactgaaatgcggggacaaggactgagtccggatgtagtcacctattcaactctaatatctgcactttggagaatgggtaagctgactgatgctatggataggttcagtcagatggttgttggtacgggagtacagccggacacagttgtttatcactccctagttcagttcttatgtacacatggtgatttggtgaaagcgaaggagttgatttctgaaatgatgaataaaggtattgctcgtccaaacactgcactcttcagttcaataatggacagtctacgcaatgaaggaagggttatagatgcacaccatatctttgacttggttatagacataggtgagaaacctgatagcagtatgtttagtacgctgattgacggatattgcttagtcggtgagatggacaaagcatgtggagtacttgatgccatggtatcagctggcattgagcctaatgtcattacgtatagcacacttgtcagtagatattgtaaacgtggaaggatcgctaatgggttgattctgttcagacaaatgttgcataagaaagttaaacctacaactgttacatatgaaaccatactgaatggattatttcgtgctgggagaactgctgatgcgaagaaaatcttcgatgagatgatcgaaagtggaataatggtgagcatttctacatataatataattcttggaggactttgtagaaataattgcgcagatgaagcgattgtcctattccagaacgtgcaa

SEQ ID NO: 1606 - DNA, 876 bp, Triticum aestivum
atgtccagcatccacctccgccactgctccactatgcccatgccccgcgtctgcctccgccgccgcctctcctcctccttctcctcctccttctccaactgcacctcgccgccctcaccaccctggtctccccacgcagcctttgccgcggccacagagcgcgtacgagccgggacgctcagcccgcaagacgcacaccacctgttcgacgtattgtttcagcaggccactcgggtccccgagcgctcccttgatggattccttgccgccctcggcggtgctgcgtcctctgaagcctgcagagacggccccgccctcgccctcgcccttttcaaccgtatcttccgagaagaagccggcatgcgggtggcgccgcccaccatcttcacttatggcatcctcatgaactgctgctgccgcgtacgtcgtccggacctagggcttgccttctttgggcgcatccttagggcgggcctgaagacaaaccagatcgcggccaacacggtcatcaagtgcctctgctgcgcaaaacatactgacgaggctgtcaatatgctgcttcataggatgtccgacctaggctgtgtgcctgatgacttctcatacaacacagttctgaagagcttgtgtgaagacggcaggagcttgcaggcgcttgacctactgctccagatggtgtccaaggaaggaggtgcctgctcccctgacacggtggcatatagcacggtcatccacggcttcttgaaggaaggcaaagtagacaaggcatgcaatctattcaatgaaatgatgcggcaaggggttgtgcctgatgtggtgacctatgtttttaaggcggtaaggcgaggcgaggcgctgggggggcgcctcactgcc

SEQ ID NO: 1607 - DNA, 1197 bp, Triticum aestivum; identical to SEQ ID NO: 1605

SEQ ID NO: 1608 - DNA, 2499 bp, Triticum aestivum
atgtccagcatccacctccgccactgctccactatgcccatgccccgcgtctgcctccgccgccgcctctcctcctccttctcctcctccttctccaactgcacctcgccgccctcaccaccctggtctccccacgcagcctttgccgcggccacagagcgcgtacgagccgggacgctcagcccgcaagacgcacaccacctgttcgacgtattgtttcagcaggccactcgggtccccgagcgctcccttgatggattccttgccgccctcggcggtgctgcgtcctctgaagcctgcagagacggccccgccctcgccctcgcccttttcaaccgtatcttccgagaagaagccggcatgcgggtggcgccgcccaccatcttcacttatggcatcctcatgaactgctgctgccgcgtacgtcgtccggacctagggcttgccttctttgggcgcatccttagggcgggcctgaagacaaaccagatcgcggccaacacggtcatcaagtgcctctgctgcgcaaaacatactgacgaggctgtcaacatgctgcttcataggatgtccgacctaggctgtgtgcctgatgacttctcatacaacacagttctgaagagcttgtgtgaagacggcaggagcttgcaggcgcttgacctactgctccagatggtgtccaaggaaggaggtgcctgctcccctgacacggtggcatatagcacggtcatccacggcttcttgaaggaaggcaaagtagacaaggcatgcaatctattcaatgaaatgatgcggcaaggggttgtgcctgatgtggtgacgtatagctcgattatcgatgcattgtgcaaagccggagcaatgcacaaggcagagttgttccttcggcagatggttcataacggtgttcgaccggatgaggtgacatatactagcatgatccatggatattccactttgggccggctgaaagaggtgcgtaaaattttcagagaaatgacaagccgtggtcttataccagatattgtcacttggaactcgctcatggactccctttgcaagcatggaagaaccaaagaagctgcaaaggttttcttttccatggctgcaaagggcaacaagcctaatattgtctcctacactattcttcttcatgggtatgccaatgaaggaagctttgctgatatgatgagtctcttcaattcaatgaaaggcggtggcattgtagccaactgcaaagttttcaacatattaattggtgcatatgctaaacgagggctgatagatgaagctatgctcatacttactgaaatgcggggacaaggactgagtccggatgtagtcacctattcaactctaatatctgcactttggagaatgggtaagctgactgatgctatggataggttcagtcagatggttgttggtacgggagtacagccggacacagttgtttatcactccctagttcagttcttatgtacacatggtgatttggtgaaagcgaaggagttgatttctgaaatgatgaataaaggtattgctcgtccaaacactgcactcttcagttcaataatggacagtctacgcaatgaaggaagggttatagatgcacaccatatctttgacttggttatagacataggtgagaaacctgatagcagtatgtttagtacgctgattgacggatattgcttagtcggtgagatggacaaagcatgtggagtacttgatgccatggtatcagctggcattgagcctaatgtcattacgtatagcacacttgtcagtagatattgtaaacgtggaaggatcgctaatgggttgattctgttcagacaaatgttgcataagaaagttaaacctacaactgttacatatgaaaccatactgaatggattatttcgtgctgggagaactgctgatgcgaagaaaatcttcgatgagatgatcgaaagtggaataatggtgagcatttctacatataatataattcttggaggactttgtagaaataattgcgcagatgaagcgattgtcctattccagaaattacgtgcaatgaatgtgaagttcaatatcacaacactcaataccatcattaatgcattgtacaaggttgaaagaagagaagaagctaatgatttgtttgctgcattaccagccagcgggttggtgcctaatgcttccacttacggagtaatggtacaaaatcttctaaaagaaggagcagtggaggaagctgacagtatgttctcatcaatggagaagagtggctgtgctcctagctctcgtcttataaatgatgtcatcagaactttattggaaaagggggagatagtcaaggctggaaaatatatgtctaaagttgatgggaagagcatctcacttgaagcttcaactagttcgttgttgttgtctctcttttcagggaatgggaaatatcggaaacaactacaattgctccctgcaaagtaccaattttttaaaggaatcagt

SEQ ID NO: 1609 - DNA, 876 bp, Triticum aestivum; identical to SEQ ID NO: 1606

SEQ ID NO: 1610 - DNA, 876 bp, Triticum aestivum; identical to SEQ ID NO: 1606

SEQ ID NO: 1611 - DNA, 2508 bp, Triticum aestivum
atgtccagcatccacctccgccactgctccactatgcccatgtcccgcgtctgcctccgccgccgcctctcctcctcctcctcctcctcctcctcctccttctccaactgcacctcgccgccctcaccaccctggtctccccacgccgcctttgccgcggccacagagcgcgtacgagccgggacgctcagcccgcaagacgcacaccacctgttcgacgtattgtttcagcaggccactcgggtccccgagcgctcccttgatggattccttgccgccctcggcggtgctgcgtcctccgaagcctgcagagacggccccgccctcgccctcgcccttttcaaccgtatcttccgagaagaagccggcatgcgggtggcgccgcccaccatcttcacctatggcatcctcatgaactgctgctgccgcgtacgtcgtccagacctagggcttgccttctttgggcgcatcctcagggcgggcctgaagacaaaccagatcgcggccaacaccgtcatcaagtgcctctgctacgcaaaacatactgacgaggctgtcaatatgctgcttcataggatgtccgacctcggctgtgtgcctgatgacttctcatacaacacagttctgaagagcttgtgtgaagacggcaggagcttgcaggcgcttgacctactgctccagatggtgtccaaggaaggaggtgcctgctcccctgacacggtggcatatagcacggtcatccatggcttcttgaaggaaggcaaagtagacaaggcatgcaatctattcaatgaaatgatgcggcaaggggttgtgcctgatgtggtgacgtatagctcgattatcgatgcattgtgcaaagccggagcaatgcacatggcagagttgttccttcggcagatggttgataacgatgttcgaccggatgaggtgacatatactagcatgatccatggatattccactttgggccggctgaaagaggtgcgtaaaatgttcagagaaatgacaagccgtggtcttataccagatattgtcacttggaactcgttcatagactccctttgcaagcatggaagaaccaaagaagctgcaaaggttttcttttccatggctgcaaagggcagcaagcctaatattgtctcctacactattcttcttcatgggtatgccaatgaaggaagctttgctgatatgatgagtctcttcaattcaatgaaaggcggtggcattgtagccaactgcaaagttttcaacatattaattggtgcatatgctaaacgagggctgatagatgaagctatgctcatacttactgaaatgcggggacaaggactgagtccagatgtattcacctattcaactctaatatctgcacattggagaatgggtaagctgactgatgccatggataagttcagtcagatggttgttggtacgggagtacagccggacgcagttgtttatcactccctagttcagttcttatgtacacatggtgatttggtgaaagcgaaggagttgctttctgaaatgatgaataaaagtattgctcgtccaaacactgcactcttcagttcaataatggacagtctatgcaatgaaggaagggttatagatgcacaccatatctttgacttggttatagatataggtgagaaacctgatatcagtatgtttagtatgctgattgacggatattgcttagtcggtgagatggacaaagcatgtggagtacttgatgccatggtatcagctggcattgagcctaatgtcattacgtatagcacacttgtcagtagatattgtaaacgtggaaggatcgatgatgggttgattctgttcagacaaatgttgcataagaaagttaaacctacaactgttacatatgaaaccatactgaatggattatttcgtgctgggagaactgttgatgcgaagaaaatcttcgatgagatgatcgaaagtggaataatggtgagcatttctacatataatataattcttggaggactttgtagaaataattgcgcagatgaagcgatcgtcctattccagaaattacgtgcaatgaatgtgaagttcaatatcacaacactcaataccatcattaatgcattgtacaaggttgaaagaagagaagaagctaatgatttgtttgctgcattaccagccagcgggttggtgcctaatgcttccacttacggagtaatggtacaaaatcttctaaaagaaggagcagtggaggaagctgacagtatgttctcatcaatggagaagactggctgtgctcctagctctcgtcttataaatgatgtcatcagaactttgttggaaaagggggagatagttaaggccggaaaatatatgtctaaagttgatgggaagagcatctcacttgaagcttcaactagttcgttgttgttgtctctcttttcagggaatgggaaatatcggaaacaactacaattgctccctgcaaagtaccaattttttgaaggaatcagt

SEQ ID NO: 1612 - DNA, 1197 bp, Triticum aestivum; identical to SEQ ID NO: 1605

SEQ ID NO: 1613 - DNA, 1197 bp, Triticum aestivum; identical to SEQ ID NO: 1605

SEQ ID NO: 1614 - DNA, 876 bp, Triticum aestivum; identical to SEQ ID NO: 1606

SEQ ID NO: 1615 - DNA, 2499 bp, Triticum aestivum; identical to SEQ ID NO: 1608

SEQ ID NO: 1616 - DNA, 2472 bp, Triticum aestivum
atgccccgtctccgcctccgccgcttctccaccgcgccgatgttccacctcctccaccgcagctcctcctccacctccacctcgccgccctcgcgttcctggtctccccatgccgcctttgccgccgccacagagcgtgtccgtgccgggacgctcagcccagaagacgcgcaccacctgttcgacgaattgctacggcaggccaccccggtcaccgggcgctccctcaacggcttcctttccgccctcgcccgtgcgcccgcctcggccgcctgcattagagatggccccgcccttgccgtcgctctcttcaaccgcgtatgccgagaagaagccagccagcaggtggcacctttgacagtccacacctacggcatcctcatgggctgcttctgcggtgcgcgtcgcccggacctagggcttgccttattcggccgcttcctcaggacgggcctgaagacaaatgagatcatcgccaccaccttcctcaagtgcctctgctccgccaaacgtacagatgaggctgtcaacttgctgcttcataggatgcctgagcttggctgcgtgcctaatgcaatctcctactccattgttctgaagagcttatgtgaaaatagcatgagtcagcgggcactcgacttgctacagactgtggcggaaggaggaggtgcctgctctctcaatgtggtggcatatagcacagtcatccatggtttttttaaagaaggcaaaacaggcaaggcatgcaatctattccatgaaatgatacatcaaggggttgatcctgatgtggtgacgtacaacttgatcattgatgcattgtgcaaggccagagcgatggacaaggcagaactagtccttcagcagatggtcgataaaggtgttcaacccaacacagtgacatataattgcatgatccatggatattccacatcagggcagttgaaagaggctgctaaaatgtttagaaaaatgacaagccatggtcttgtaccaaatgcagtcacttgcaacttgttaatgacttccctttgcaagcatggaagaagcaaagaagcggcagaaatattttattccatgactgccaagggccacaaactggatgccgtctcgtaccgtattttgcttcatgggtatgccactgagggatgctttgctgatatgattgatctcttcaattcaatggaaagcaatggttttgtagccgattgccatgttttcaccatattaattgatgcatatgctaaacgtggaatgatggatgaagctatgctcatatttactgaaatgcgggaaaaaggagtgagtcccaatgtagtcacctattccactgtaatagccgcattttgcagattgcgtaggctggccaatgctatggacaagttcaatgagatgactgatatgggtgttcagccggacacaactgtttatcactccctaattcagggtttttgtatgcatggtgatttggttaaagttaaggaatttgtgtctgaaatgatgaacaaaggtattcctcgtcctgacattgcgttcttcaattcagtaataaactctttatgcaaagaaggaagggttatgaatgcacaaggtatctttgacttggttataggcatgggcgagaggcctaatgtcattacattcagttcactgattgacggatatggcttagtcggccagatgggtgaagcactcggagtgcttgatgccatggtgtcagctggcattgagcctaatgttgttacgtatagttcaattcttgatggctattgtagaaatggaaggatcaatgatgctttgattctattcagagaaatgccgcgcaagagaattaaacctaacactgttacatatggcatcatgctggatgggttgttccgtgctgggagaactgttgctgcaagggaaatgttccatgagatgaccgaaaggggtataccagtgagcatttccatatacaatataatacttggtggtctttgtagaaataattgtgcagacgaagcgatcacactattccagaaattaggagcaatgaatgtcaagttcgatattataacactcaataccatgattaatgcaatgttcaaggttcggagaagagaagaagctaacgatttgtttgctgcagtatcagccagtgggttggtgcctaatgcttctacttacggcatagtgataaaaaatattctaaaggaaggatcagtggaagaagttgacaatatgttttcatcaatggagaagagtggttgtgctcccagctctcgtcttataaattatatcatcagaatgttgttggaaaaaggtgagattgccagggccgggaattatttatctaaagttgatgggaagatcatctcacttgaagcttcaactacttctttgctgttgtctctcttttcaagggaagggaaatatcgggaaaacattgaattgcttcctgcaaagtatcaatttttcaatggatttggt

SEQ ID NO: 1617 - DNA, 1791 bp, Triticum aestivum
atgtggtggcatatagcacagtcatccatggttttttttaaagaaggcaaaacaggcaaggcatgcaatctattccatgaaatgatacatcaaggggttgatcctgatgtggtgacgtacaacttgatcattgatgcattgtgcaaggccagagcgatggacaaggcagaactagtccttcagcagatggtcgataaaggtgttcaacccaacacagtgacatataattgcatgatccatggatattccacatcagggcagttgaaagaggctgctaaaatgtttagaaaaatgacaagccatggtcttgtaccaaatgcagtcacttgcaacttgttaatgacttccctttgcaagcatggaagaagcaaagaagcggcagaaatattttattccatgactgccaagggccacaaactggatgccgtctcgtaccgtattttgcttcatgggtatgccactgagggatgctttgctgatatgattgatctcttcaattcaatggaaagcaatggttttgtagccgattgccatgttttcaccatattaattgatgcatatgctaaacgtggaatgatggatgaagctatgctcatatttactgaaatgcgggaaaaaggagtgagtcccaatgtagtcacctattccactgtaatagccgcattttgcagattgcgtaggctggccaatgctatggacaagttcaatgagatgactgatatgggtgttcagccggacacaactgtttatcactccctaattcagggtttttgtatgcatggtgatttggttaaagttaaggaatttgtgtctgaaatgatgaacaaaggtattcctcgtcctgacattgcgttcttcaattcagtaataaactctttatgcaaagaaggaagggttatgaatgcacaaggtatctttgacttggttataggcatgggcgagaggcctaatgtcattacattcagttcactgattgacggatatggcttagtcggccagatgggtgaagcactcggagtgcttgatgccatggtgtcagctggcattgagcctaatgttgttacatatagttcaattcttgatggctattgtagaaatggaaggatcaatgatgctttgattctattcagagaaatgccgcgcaagagaattaaacctaacactgttacatatggcatcatgctggatgggttgttccgtgctgggagaactgttgctgcaagggaaatgttccatgagatgaccgaaaggggtataccagtgagcatttccatatacaatataatacttggtggtctttgtaaaaataattgtgcagacgaagcgatcgcactattccagaaattaggagcaatgaatgtcaagttcgatattataacactcaataccatgattaatgcaatgttcaaggttcggagaagagaagaagctaacgatttgtttgctgcagtatcagccagtgggttggtgcctaatgcttctacttacggcatagtgataaaaaatattctaaaggaaggatcagtggaagaagttgacaatatgttttcatcaatggagaagagtggttgtgctcccagctctcgtcttataaattatatcatcagaatgttgttggaaaaaggtgagattgccagggccgggaattatttatctaaagttgatgggaagatcatctcacttgaagcttcaactacttctttgctgttgtctctcttttcaagggaagggaaatatcgggaaaacattgaattgcttcctgcaaagtatcaatttttcaatggatttggt

SEQ ID NO: 1618 - DNA, 1068 bp, Triticum aestivum
atgttatttcctgatgaatttttgcaaactaacaaaaaaatttgtcaaagtttggcacggaaaattttcagagtttttggaatttatttaccttttttaaaattttattttactgtttataagagagcatttgagatcgggactggatactcctcgtcccggccattctccctttctcagtgcagagccagagcacgcccatgtctcgcatccccatccgccgccgccgccgctcatcgtcctccacctagacagtgtccggcctccaccactcctcctcctcctccacctagccattctccgacctctgcctccgccacttctcctcccctgtcccccacctcgccgatgccccgtctccgcctccgccgcttctccaccgcgccgatgttccacctcctccaccgcagctcctcctccacctccacctcgccgccctcgcgttcctggtctccccatgccgcctttgccgccgccacagagcgtgtccgtgccgggacgctcagcccagaagacgcgcaccacctgttcgacgaattgctacggcaggccaccccggtcaccgggcgctccctcaacggcttcctttccgccctcgcccgtgcgcccgcctcggcctcctgcattagagatggccccgcccttgccgtcgctctcttcaaccgcgtatgccgagaagaagccagccagcaggtggcacctttgacagtccacacctacggcatcctcatgggctgcttctgcggtgcgcgtcgcccggacctagggcttgccttattcggccgcttcctcaggaagggcctgaagacaaatgagatcatcgccaccaccttcctcaagtgcctctgctccgccaaacgtacagatgaggctgtcaacttgctgcttcataggatgcctgagcttggctgcgtgcctaatgcaatctcctactccattgttctgaagagcttatgtgaaaatagcatgagtcagcgggcactcgacttgctacagactgtggcggaaggaggaggtgcctgctctctcaatgtggtggcatatagcacagtcatccatggttttttt

SEQ ID NO: 1619 - DNA, 579 bp, Triticum aestivum
atgatagttcggctgtccggacaccccctagtccgggactccctcaatgaggctgtcaacttgctgcttcataggatgcctgagcttggctgcgtgcctaatgcaatctcctactccattgttctgaagagcttatgtgaaaatagcatgagtcagcgggcactcaacttgctacagacagtggcggaaggaggaggtgcctgctctctcaatgtggtggcatataacacagtcatccatggtatttttaaagaaggcaaaacaggcaaggcatgcaatctattccatgaaatgatacatcaaggggttgatcctgatgtggtgacgtacaacttgatcattgatgcattgtgcaaggccagagcgatggacaaggcagaactagtccttcagcagatggtcgataaaggtgttcaacccaacacagtgacatataattgcatgatccatggatattccacatcagggcagttgaaagaggctgctaaaatgtttagaaaaatgacaagccatggtcttgtaccaaatgcagtcacttgcaactcgttaatgacttccctttgcaagcatggaagaagc

SEQ ID NO: 1620 - DNA, 2472 bp, Triticum aestivum
atgccccgtctccgcctccgccgcttctccaccgcgccgatgttccacctcctccaccgcagctcctcctccacctccacctcgccgccctcgcgttcctggtctccccatgccgcctttgccgccgccacagagcgtgtccgtgccgggacgctcagcccagaagacgcgcaccacctgttcgacgaattgctacggcaggccaccccggtcaccgggcgctccctcaacggcttcctttccgccctcgcccgtgcgcccgcctcggccgcctgcattagagatggccccgcccttgccgtcgctctcttcaaccgcgtatgccgagaagaagccagccagcaggtggcacctttgacagtccacacctacggcatcctcatgggctgcttctgcggtgcgcgtcgcccggacctagggcttgccttattcggccgcttcctcaggacgggcctgaagacaaatgagatcatcgccaccaccttcctcaagtgcctctgctccgccaaacgtacagatgaggctgtcaacttgctgcttcataggatgcctgagcttggctgcgtgcctaatgcaatctcctactccattgttctgaagagcttatgtgaaaatagcatgagtcagcgggcactcgacttgctacagactgtggcggaaggaggaggtgcctgctctctcaatgtggtggcatatagcacagtcatccatggtttttttaaagaaggcaaaacaggcaaggcatgcaatctattccatgaaatgatacatcaaggggttgatcctgatgtggtgacgtacaacttgatcattgatgcattgtgcaaggccagagcgatggacaaggcagaactagtccttcagcagatggtcgataaaggtgttcaacccaacacagtgacatataattgcatgatccatggatattccacatcagggcagttgaaagaggctgctaaaatgtttagaaaaatgacaagccatggtcttgtaccaaatgcagtcacttgcaacttgttaatgacttccctttgcaagcatggaagaagcaaagaagcggcagaaatattttattccatgactgccaagggccacaaactggatgccgtctcgtaccgtattttgcttcatgggtatgccactgagggatgctttgctgatatgattgatctcttcaattcaatggaaagcaatggttttgtagccgattgccatgttttcaccatattaattgatgcatatgctaaacgtggaatgatggatgaagctatgctcatatttactgaaatgcgggaaaaaggagtgagtcccaatgtagtcacctattccactgtaatagccgcattttgcagattgcgtaggctggccaatgctatggacaagttcaatgagatgactgatatgggtgttcagccggacacaactgtttatcactccctaattcagggtttttgtatgcatggtgatttggttaaagttaaggaatttgtgtctgaaatgatgaacaaaggtattcctcgtcctgacattgcgttcttcaattcagtaataaactctttatgcaaagaaggaagggttatgaatgcacaaggtatctttgacttggttataggcatgggcgagaggcctaatgtcattacattcagttcactgattgacggatatggcttagtcggccagatgggtgaagcactcggagtgcttgatgccatggtgtcagctggcattgagcctaatgttgttacgtatagttcaattcttgatggctattgtagaaatggaaggatcaatgatgctttgattctattcagagaaatgccgcgcaagagaattaaacctaacactgttacatatggcatcatgctggatgggttgttccgtgctgggagaactgttgctgcaagggaaatgttccatgagatgaccgaaaggggtataccagtgagcatttccatatacaatataatacttggtggtctttgtagaaataattgtgcagacgaagcgatcacaatattccagaaattaggagcaatgaatgtcaagttcgatattataacactcaataccatgattaatgcaatgttcaaggttcggagaagagaagaagctaacgatttgtttgctgcagtatcagccagtgggttggtgcctaatgcttctacttacggcatagtgataaaaaatattctaaaggaaggatcagtggaagaagttgacaatatgttttcatcaatggagaagagtggttgtgctcccagctctcgtcttataaattatatcatcagaatgttgttggaaaaaggtgagattgccagggccgggaattatttatctaaagttgatgggaagatcatctcacttgaagcttcaactacttctttgctgttgtctctcttttcaagggaagggaaatatcgggaaaacattgaattgcttcctgcaaagtatcaatttttcaatggatttggt

SEQ ID NO: 1621 - DNA, 1017 bp, Triticum aestivum
atgcatggtgatttggttaaagttaaggaatttgtgtctgaaatgatgaacaaaggtattcctcgtcctgacattgcgttcttcaattcagtaataaactgtttatgcaaagaaggaagggttatgaatgcacaaggtatctttgacttggttataggcatgggcgagaggcctaatgtcattacattcagttcactgattgacggatatggcttagtcggccagatgggtgaagcactcggagtgcttgatgccatggtgtcagctggcattgagcctaatgttgttatgtatagttcaattcttgatggctattgtagaaatggaaggatcaatgatgctttgattctattcagagaaatgccgcgcaagagaattaaacctaacactgttacatatggcatcatgctggatgggttgttccgtgctgggagaactgttgctgcaagggaaatgttccatgagatgaccgaaaggggtatatcagtgagcatttccatatacaatataatacttagtggtctttgtagaaataattgtgcagacgaagcgatcgcactattccagaaattaggagcaatgaatgtcaagttcgatattataacactcaataccatgattaatgcaatgttcaaggttcggagaagagaagaagctaacgatttgtttgctgcagtatcagccagtgggttggtgcctactgcttctacttatggcatagtgataaaaaatattctaaaggaaggatcagtggaagaagttgacaatatattttcatcaatggagaagagtggttgtgctcccagctctcgtcttataaattatatcatcagaatgttgttggaaaaaggtgagattgccagggccgggaattatttatctaaagttgatgggaagatcatctcacttgaagcttcaactacttctttgttgttgtccctcttttcaagggaagggaaatatcgggaaaacattgaattgcttcctgcaaagtatcaatttttcaatggatttggt

SEQ ID NO: 1622 - DNA, 1068 bp, Triticum aestivum; identical to SEQ ID NO: 1618

SEQ ID NO: 1623 - DNA, 1791 bp, Triticum aestivum; identical to SEQ ID NO: 1617

SEQ ID NO: 1624 - DNA, 1791 bp, Triticum aestivum; identical to SEQ ID NO: 1617

SEQ ID NO: 1625 - DNA, 1068 bp, Triticum aestivum; identical to SEQ ID NO: 1618

SEQ ID NO: 1626 - DNA, 2472 bp, Triticum aestivum; identical to SEQ ID NO: 1616

SEQ ID NO: 1627 - DNA, 1227 bp, Triticum aestivum
atggtatcgtacggaatggatgaggctatgcacatgttcgaagtaatgaggcaacaaggagtaaacccagatgtatttggctatcaaatcataatggattcactttgcaaaatgggcaagatggctgctgctatggatatatttaatcagatggtcaatcaaggagtttcacctaacaaagctgtttaccaatgcctggttctgggttcttgctctcatggtcattttgtgaaagccaaggaattgatttctgaagcggttaatagaggtctgtgttctaacagtgtgttcttctatcctgtaataaacgaccgttgcaaagaaggaaaggtgaaggaggcacaggatatgtttgacttcattgtaggtattggtcatcggcctgatgtgattatgtacaattcactgatggatggatattgccatgttggcaaggtggaggaagcactgagagtacttgatgctatgaagtctgctggcctccaacctgatgtttttacatatggtatacttattaatggctactgtaaaattggaaggatcgacgagggattgagtcttgtcagggaaatttcactcagtggggttaagcccacgactattatgtacaacattatacttgatgggctgttttgctctgggagaacagttcctgcaaaggaaaaattccataagatgaatgaaagtggcataccagtgggcgttggaacatacaacatagttcttagtggactttgtaaaaataattgcactgatgaagcaatagagctgttcaagaaattacgtgctgtgaacgtgaagattaatgtcataacactcactaccatgatttctgcaatgtttaaaactaggagaattgaagaagccaaggatttgtttgctactatatcagccattgggttggtgccttctgttgtgacttacagtataatgatgacaaatttcataaaagaagggttgcttgcagatgctgatgatatgttttcagcaatggagaaggctggctgtgctcacaactccagactgctaaatcaagtggtcagggtatttctgaagaatggtgaagttgtaaaggctgtgacttatcttgccaaacttgatgcaaaacagctgtcagttgaagcttcgacggtttcgttaatagtatctctcttctcaaggaaagggaaattaagggagcatgtaaaattgcttccggtaaagtaccagcctcctgagatgttggac

SEQ ID NO: 1628 - DNA, 1227 bp, Triticum aestivum; identical to SEQ ID NO: 1627

SEQ ID NO: 1629 - DNA, 1227 bp, Triticum aestivum; identical to SEQ ID NO: 1627

SEQ ID NO: 1630 - DNA, 1398 bp, Triticum aestivum
atgacagccaagggccaaaaacctgatatcatctcgtattgtactttgcttcatgggcatgccagagaaggatgctttactgatatgattgatctctttaattcaatgaaaagcaatggtattgcagccgactgccatgttttcaccatattaattgatacctatgctaaacgcggaatgatggatgatgcaatgcacatatttacggaaatgcagcaacaaggtgtgagtccaaatgttgtcacatattcaactgtaatatcagcactttctagaatgggtaggttgaccgatgctatggaaaaatttaatcagatggttgccttgggagtacagccggatagagctatttatcagtccctaattcagggcttttgtatgcatggtggtttggttaaagctaaggagttggtttctcaaatgataaacaaaggtattcctcatcctaacattgtgttcttcaattcagtaataaacagtatgtgcaaggaaggcagggttatggatgcacatgatatctttgacttggttatagacataggtgataggcctgatgacacttcatttaattcactgattgatggatattgcttagtcgggaagatggataaagcattcggaatgcttaatgccatggaatcagttggtgttgagcctgatattgttacttacagtacacttgttaatggctattgtagaaatggaaggatcgatgatggtttgactctgtttagagaaatgatgtgcaagggagttaaacctacaactgtgacatatggcatcatactggatgggttgtttcattctgggagaactgttgctgcaatgaaaatgttccatcagatgattgaaagtggaacaacagtgaccatttccacgtacagtataatacttggaggtctttgtagaaataattgtgcagacgaagcgattgtcctgttccagaaattaggagcaatgattgtaaagttcagtattacaatactcaataccatgattaatgcaatgtacaaggttcaaagaaaagaagaagctaaggagttgttcggtacaatatcagccagtgggttggtgcctaatgaatgtacttatggagtaatgataaaaaatcttctggaagaaggatcagtggaagaagctgacaatatgttttcgtttatggacaggagtggtatagtccccagctcccgtcttatgaatgatatcatcagaatgttgttggaaaaaggtgagattgccaaggccggatattatctgtctaaagttgatggaaagagcatatcacttgaagcttcaactacttcattgatgttttctctcttttcaaggaaaagcaaatatcaggaggatatgaaattgctccctgcaaagtatcaaattttcgacggattagttgtc

SEQ ID NO: 1631 - DNA, 2619 bp, Triticum aestivum
atgtcccgccgcatccgccttcgccgcgcgctcctactccggctgaagtccggcctgcgccactcctttacctcgccgttttcccgcctccgcatccgcctccgccgctattccaccgcgccgatgtctcgcctccgtctccgcctcccccgcggcagctcctcccccaccacactgataccccgcctccggctcctccgccgctgctccacctccacctccatgtcgtcgccctcacgctcctggtctccccgagacgcctttgccgcggccacggagcgtgttcgcgccgggacgctcagcctggaagacgctcacaaactgttcgacgaattgctcggtcaggccaccccggtcccggagcgctccctgaacggcttccttgccgccctcgcccgcgcgcccgcctccggtgcctgcatcagagatggccccgcccttgcagtggctctcttcaaccgtgtgtgcagagaggaagccggcgcgcaggtggcggcgctcacagtttgcacctacaacatcctcatggactgctgctgccgtgcgcgtcgtccggacctagggcttgccttatttggctgcttcctcaggaagggcctgaagacagaccagaccggcgccaacaccttcctcaagtgcctctgctacgcgaaacggacggatgaggctgtgaacgtgctcctccacaggatgtccgagctcggctgtgtgcctaatgccgtttcgtacaacactgttctgaagggcttatgcgacaatagcatgagtcagcgggcgctcgacctgctccagatggtggcgggaaaaggaggtggctgcttccctgatgtggtggcgtatagcacggtcatccatggcttttttaaggagggtgaaacagggaaggcatgcagtctattccatgaaatgatgcagcaagggattgtgcccagtgtggtgacatataactcgattattgatgcgttgtgcaaggtcagagaagtggacaaggcagagctagtccttcgtcagatggttgctaaaggtgctcaacccgatacagtgacatataattgcatgatcaatggatatgccacatctgggcggttgaaagaggctgctaaaatgttcagagaaatgaaaagccggggtcttacaccaaatgttgttacttgcaactcgttcctggcctccctttgcaagcaccgaagtagcaaagaagctgcagaattttttgattccatgacagccaagggccaaaaacctgatatcatctcgtattgtactttgcttcatgggcatgccagagaaggatgctttactgatatgattgatctctttaattcaatgaaaagcaatggtattgcagccgactgccatgttttcaccatattaattgatacctatgctaaacgcggaatgatggatgatgcaatgcacatatttacggaaatgcagcaacaaggtgtgagtccaaatgttgtcacatattcaactgtaatatcagcactttctagaatgggtaggttgaccgatgctatggaaaaatttaatcagatggttgccttgggagtacagccggatagagctacttatcagtccctaattcagggcttttgtatgcatggtggtttggttaaagctaaggagttggtttctcaaatgataaacaaaggtattcctcatcctaacattgtgttcttcaattcagtaataaacagtatgtgcaaggaaggcagggttatggatgcacatgatatctttgacttggttatagacataggtgataggcctgatgacacttcatttaattcactgattgatggatattgcttagtcgggaagatggataaagcattcggaatgcttaatgccatggaatcagttggtgttgagcctgatattgttacttacagtacacttgttaatggctattgtagaaatggaaggatcgatgatggtttgactctgtttagagaaatgatgtgcaagggagttaaacctacaactgtgacatatggcatcatactggatgggttgtttcattctgggagaactgttgctgcaatgaaaatgttccatcagatgattgaaagtggaacaacagtgaccatttccacgtacagtataatacttggaggtctttgtagaaataattgtgcagacgaagcgattgtcctgttccagaaattaggagcaatgaatgtaaagttcagtattacaatactcaataccatgattaatgcaatgtacaaggttcaaagaaaagaagaagctaaggagttgttcggtacaatatcagccagtgggttggtgcctaatgaatgtacttatggagtaatgataaaaaatcttctggaagaaggatcagtggaagaagctgacaatatgttttcgtttatggacaggagtggtatagtccccagctcccgtctcatgaatgatatcatcagaatgttgttggaaaaaggtgagattgccaaggccggatattatctgtctaaagttgatggaaagagcatatcacttgaagcttcaactacttcattgatgttttctctcttttcaaggaaaagcaaatatcaggaggatatgaaattgctccctgcaaagtatcaaattttcgacggattagttgtc

SEQ ID NO: 1632 - DNA, 2619 bp, Triticum aestivum
atgtcccgccgcatccgccttcgccgcgcgctcctactccggctgaagtccggcctgcgccactcctttacctcgccgttttcccgcctccgcatccgcctccgccgctattccaccgcgccgatgtctcgcctccgtctccgcctcccccgcggcagctcctcccccaccacactgataccccgcctccggctcctccgccgctgctccacctccacctccacgtcgtcgccctcacgctcctggtctccccgagacgcctttgccgcggccacggagcgtgttcgcgccgggacgctcagcctggaagacgctcacaaactgttcgacgaattgctcggtcaggccaccccggtcccggagcgctccctgaacggcttccttgccgccctcgcccgcgcgcccgcctccggtgcctgcatcagagatggccccgcccttgcagtggctctcttcaaccgtgtgtgcagagaggaagccggcgcgcaggtggcggcgctcacagtttgcacctacaacatcctcatggactgctgctgccgtgcgcgtcgtccggacctagggcttgccttatttggctgcttcctcaggaagggcctgaagacagaccagaccggcgccaacaccttcctcaagtgcctctgctacgcgaaacggacggatgaggctgtgaacgtgctcctccacaggatgtccgagctcggctgtgtgcctaatgccgtttcgtacaacactgttctgaagggcttatgcgacaatagcatgagtcagcgggcgctcaacctgctccagatggtggcgggaaaaggaggtggctgcttccctgatgtggtggcgtatagcacggtcatccatggcttttttaaggagggtgaaacagggaaggcatgcagtctattccatgaaatgatgcagcaagggattgtgcccagtgtggtgacatataactcgattattgatgcgttgtgcaaggtcagagaagtggacaaggcagagctagtccttcgtcagatggttgctaaaggtgctcaacccgatacagtgacatataattgcatgatcaatggatatgccacatctgggcggttgaaagaggctgctaaaatgttcagagaaatgaaaagccggggtcttacaccaaatgttgttacttgcaactcgttcctggcctccctttgcaagcaccgaagtagcaaagaagctgcagaattttttgattccatgacagccaagggccaaaaacctgatatcatctcgtattgtactttgcttcatgggcatgccagagaaggatgctttactgatatgattgatctctttaattcaatgaaaagcaatggtattgcagccgactgccatgttttcaccatattaattgatacctatgctaaacgcggaatgatggatgatgcaatgcacatatttacggaaatgcagcaacaaggtgtgagtccaaatgttgtcacatattcaactgtaatatcagcactttctagaatgggtaggttgaccgatgctatggaaaaatttaatcagatggttgccttgggagtacagccggatagagctatttatcagtccctaattcagggcttttgtatgcatggtggtttggttaaagctaaggagttggtttctcaaatgataaacaaaggtattcctcatcctaacattgtgttcttcaattcagtaataaacagtatgtgcaaggaaggcagggttatggatgcacatgatatctttgacttggttatagacataggtgataggcctgatgacacttcatttaattcactgattgatggatattgcttagtcgggaagatggataaagcattcggaatgcttaatgccatggaatcagttggtgttgagcctgatattgttacttacagtacacttgttaatggctattgtagaaatggaaggatcgatgatggtttgactctgtttagagaaatgatgtgcaagggagttaaacctacaactgtgacatatggcatcatactggatgggttgtttcattctgggagaactgttgctgcaatgaaaatgttccatcagatgattgaaagtggaacaacagtgaccatttccacgtacagtataatacttggaggtctttgtagaaataattgtgcagacgaagcgattgtcctgttccagaaattaggagcaatgaatgtaaagttcagtattacaatactcaataccatgattaatgcaatgtacaaggttcaaagaaaagaagaagctaaggagttgttcggtacaatatcagccagtgggttggtgcctaatgaatgtacttatggagtaatgataaaaaatcttctggaagaaggatcagtggaagaagctgacaatatgttttcgtttatggacaggagtggtatagtccccagctcccgtctcatgaatgatatcatcagaatgttgttggaaaaaggtgagattgccaaggccggatattatctgtctaaagttgatggaaagagcatatcacttgaagcttcaactacttcattgatgttttctctcttttcaaggaaaagcaaatatcaggaggatatgaaattgctccctgcaaagtatcaaattttcgacggattagttgtc

SEQ ID NO: 1633 - DNA, 2619 bp, Triticum aestivum; identical to SEQ ID NO: 1632

SEQ ID NO: 1634 - DNA, 2496 bp, Triticum aestivum
atgtctcgcctccgtctccgcctcccccgcggcagctcctcccccaccacactgataccccgcctccggctcctccgccgctgctccacctccacctccacgtcgtcgccctcacgctcctggtctccccgagacgcctttgccgcggccacggagcgtgttcgcgccgggacgctcagcctggaagacgctcacaaactgttcgacgaattgctcggtcaggccaccccggtcccggagcgctccctgaacggcttccttgccgccctcgcccgcgcgcccgcctccggtgcctgcatcagagatggccccgcccttgcagtggctctcttcaaccgtgtgtgcagagaggaagccggcgcgcaggtggcggcgctcacagtttgcacctacaacatcctcatggactgctgctgccgtgcgcgtcgtccggacctagggcttgccttatttggctgcttcctcaggaagggcctgaagacagaccagaccggcgccaacaccttcctcaagtgcctctgctacgcgaaacggacggatgaggctgtgaacgtgctcctccacaggatgtccgagctcggctgtgtgcctaatgccgtttcgtacaacactgttctgaagggcttatgcgacaatagcatgagtcagcgggcgctcgacctgctccagatggtggcgggaaaaggaggtggctgcttccctgatgtggtggcgtatagcacggtcatccatggcttttttaaggagggtgaaacagggaaggcatgcagtctattccatgaaatgatgcagcaagggattgtgcccagtgtggtgacatataactcgattattgatgcgttgtgcaaggtcagagaagtggacaaggcagagctagtccttcgtcagatggttgctaaaggtgctcaacccgatacagtgacatataattgcatgatcaatggatatgccacatctgggcggttgaaagaggctgctaaaatgttcagagaaatgaaaagccggggtcttacaccaaatgttgttacttgcaactcgttcctggcctccctttgcaagcaccgaagtagcaaagaagctgcagaattttttgattccatgacagccaagggccaaaaacctgatatcatctcgtattgtactttgcttcatgggcatgccagagaaggatgctttactgatatgattgatctctttaattcaatgaaaagcaatggtattgcagccgactgccatgttttcaccatattaatcgatacctatgctaaacgcggaatgatggatgatgcaatgcacatatttacggaaatgcagcaacaaggtgtgagtccaaatgttgtcacatattcaactgtaatatcagcactttctagaatgggtaggttgaccgatgctatggaaaaatttaatcagatggttgccttgggagtacagccggatagagctatttatcagtccctaattcagggcttttgtatgcatggtggtttggttaaagctaaggagttggtttctcaaatgataaacaaaggtattcctcatcctaacattgtgttcttcaattcagtaataaacagtatgtgcaaggaaggcagggttatggatgcacatgatatctttgacttggttatagacataggtgataggcctgatgacacttcatttaattcactgattgatggatattgcttagtcgggaagatggataaagcattcggaatgcttaatgccatggaatcagttggtgttgagcttgatattgttacttacagtacacttgttaatggctattgtagaaatggaaggatcgatgatggtttgactctgtttagagaaatgatgtgcaagggagttaaacctacaactgtgacatatggcatcatactggatgggttgtttcattctgggagaactgttgctgcaatgaaaatgttccatcagatgattgaaagtggaacaacagtgaccatttccacgtacagtataatacttggaggtctttgtagaaataattgtgcagacgaagcgattgtcctgttccagaaattaggagcaatgattgtaaagttcagtattacaatactcaataccatgattaatgcaatgtacaaggttcaaagaaaagaagaagctaaggagttgttcggtacaatatcagccagtgggttggtgcctaatgaatgtacttatggagtaatgataaaaaatcttctggaagaaggatcagtggaagaagctgacaatatgttttcgtttatggacaggagtggtatagtccccagctcccgtctcatgaatgatatcatcagaatgttgttggaaaaaggtgagattgccaaggccggatattatctgtctaaagttgatggaaagagcatatcacttgaagcttcaactacttcattgatgttttctctcttttcaaggaaaagcaaatatcaggaggatatgaaattgctccctgcaaagtatcaaattttcgacggattagttgtc

SEQ ID NO: 1635 - DNA, 2619 bp, Triticum aestivum; identical to SEQ ID NO: 1632

SEQ ID NO: 1636 - DNA, 2085 bp, Triticum aestivum
atggactgctgctgccgcgcgtctcgcccggacctagggcttgccttctttggtcgcctcctcaggacgggcctcaagacaaatgagatcgtcgctagcaccttcctcaagtgcctctgctacgccaatcgtaaggaagaggctgtcaacgtgctgcttcataggatgcccgagcttggctgtgtgcctgatgccttctcatactccattgttctgaagagcttatgtgacaacaacacgagtcagcgggggctgctccagatgatggcgaaagaaggaggtggctgctctcccaacgtggtggcatatagcacggtcatccatggcttcttcaaggaaggtgaaacgggcaaggcatgcagtctgttccaccaaatgatgcagcaaggtgttgtgcccaatgtggtgacgtataactcgattattgatgcgttgtgtaaggctagagcaatggacaaggcagagctagtccttcggcagatggttgccaatggtgctcaacccaatgaagtgacatatacttgcatgatccatgggtattccacatctgggaggttgaaagaggctgctaaaatgttcagagaaatgaaaagccggggtcttacaccaaatactgttacctgcggctcgttaatgacttccctttgcaagcatggaagaagcaaagaagctagagaaatatttgattccatgactgccaaaggccacaaacctgatattgtctcgtaccgtattttgcttcatggttatgccagtgaaggatgctttgctgatatgattgatctatgtaattcaatggaaagcaacggtattgcagccgactgccgtgtttttaccatattaattgatgcctatgctaaacgtggaatgatggatgatgcaatgcacatatttacggaaatgcagcaacgaggtgtgagtccaaatgttgtcacatattcaactgtaatatcagcactttctagaatgggtaggctgaccgatgctatggaaaaatttaatcagatggttgccttgggagtacagccgaacatacctgtttattggtccctaattcagggcttttgtatgcatggtggtttggttaaagttaaggagttggtttctcaaatgataaacaaaggtattcctcgtcctaacattgtgttcttcaattcggtaataaacggtatgtgcaaggaaggaagggttatggatgcacatgatatctttgacttggttatagacctaggtgggaggcctgatgttattacatttaattcactgattgatggatattgcttggcccgcaagctggataaagcattcggaatgtttaattccatggaatcagttggtgttgagcctgatattgttacgtacagtacacttcttgatggctattttaaaaatagaaggatcaatgatggtttggctctgtttagagaaatgccgcgtaagagaattaaacctgacattgttacatatggcatcatgttggatgggttgtttcgtgctgggagaactgttgctgcaaggacaatgttccatgagatgatcgaaagtggaataacagtggacatccccacatataatatagttcttaggggactttgtagaaataactgcacagatgaagcaatcgccctgttccagaaattaggtgcaatgagtatgaagttcaatattgcaatactcaataccatgatcaatgcaatgtacaaggttcggagaagagaagaagctaacaatttgtttgctgcaatatcaaccagtgggttggtgcccaatcaatctacttatgcagtaatgataataaatcttctaaaagatggagcagtggaacatgctagcaatatgttttcatcaatggaaaaaagtggtatagtccccagctcccgtcttataaatggtatcatcagattgttgttggagaatggtgagattgccaaggctggaatttatttgtctaaagttgatgggaatagcatctcactcgaagcttcaactacttcattgatgttgtctctattttcaaggaaagggaaatatcatgaggacatgaaattgctcccagcaaagtatcaattttttgatggatgtagt

SEQ ID NO: 1637 - DNA, 2085 bp, Triticum aestivum; identical to SEQ ID NO: 1636

SEQ ID NO: 1638 - DNA, 2085 bp, Triticum aestivum
atggactgctgctgccgcgcgtctcgcccggacctagggcttgccttctttggtcgcctcctcaggacgggcctcaagacaaatgagatcgtcgctagcaccttcctcaagtgcctctgctacgccaatcgtaaggaagaggctgtcaacgtgctgcttcataggatgcccgagcttggctgtgtgcctgatgccttctcatactccattgttctgaagagcttatgtgacaacaacacgagtcagcgggggctgctccagatgatggcgaaagaaggaggtggctgctctcccaacgtggtggcatatagcacggtcatccatggcttcttcaaggaaggtgaaacgggcaaggcatgcagtctgttccaccaaatgatgcagcaaggtgttgtgcccaatgtggtgacgtataactcgattattgatgcgttgtgtaaggctagagcaatggacaaggcagagctagtccttgggcagatggttgccaatggtgctcaacccaatgaagtgacatatacttgcatgatccatgggtattccacatctgggaggttgaaagaggctgctaaaatgttcagagaaatgaaaagccggggtcttacaccaaatactgttacctgcggctcgttaatgacttccctttgcaagcatggaagaagcaaagaagctagagaaatatttgattccatgactgccaaaggccacaaacctgatattgtctcgtaccgtattttgcttcatggttatgccagtgaaggatgctttgctgatatgattgatctatgtaattcaatggaaagcaacggtattgcagccgactgccgtgtttttaccatattaattgatgcctatgctaaacgtggaatgatggatgatgcaatgcacatatttacggaaatgcagcaacgaggtgtgagtccaaatgttgtcacatattcaactgtaatatcagcactttctagaatgggtaggctgaccgatgctatggaaaaatttaatcagatggttgccttgggagtacagccgaacatacctgtttattggtccctaattcagggcttttgtatgcatggtggtttggttaaagctaaggagttggtttctcaaatgataaacaaaggtattcctcgtcctaacattgtgttcttcaattcggtaataaacggtatgtgcaaggaaggaagggttatggatgcacatgatatctttgacttggttatagacctaggtgggaggcctgatgttattacatttaattcactgattgatggatattgcttggcccgcaagctggataaagcattcggaatgtttaattccatggaatcagttggtgttgagcctgatattgttacgtacagtacacttcttgatggctattttaaaaatagaaggatcaatgatggtttggctctgtttagagaaatgccgcgtaagagaattaaacctgacattgttacatatggcatcatgttggatgggttgttttgtgctgggagaactgttgctgcaaggacaatgttccatgagatgatcgaaagtggaataacagtggacatccccacatataatatagttcttaggggactttgtagaaataactgcacagatgaagcaatcgccctgttccagaaattaggtgcaatgagtatgaagttcaatattgcaatactcaataccatgatcaatgcaatgtacaaggttcggagaagagaagaagctaacaatttgtttgctgcaatatcaaccagtgggttggtgcccaatcaatctacttatgcagtaatgataataaatcttctaaaagatggagcagtggaacatgctagcaatatgttttcatcaatggaaaaaagtggtatagtccccagctcccgtcttataaatggtatcatcagattgttgttggagaatggtgagattgccaaggctggaatttatttgtctaaagttgatgggaatagcatctcactcgaagcttcaactacttcattgatgttgtctctattttcaaggaaagggaaatatcatgaggacatgaaattgctcccagcaaagtatcaattttttgatggatgtagt

SEQ ID NO: 1639 - DNA, 2085 bp, Triticum aestivum; identical to SEQ ID NO: 1636

SEQ ID NO: 1640 - DNA, 2085 bp, Triticum aestivum
atggactgctgctgccgcgcgtctcgcccggacctagggcttgccttctttggtcgcctcctcaggacgggcctcaagacaaatgagatcgtcgctagcaccttcctcaagtgcctctgctacgccaatcgtaaggaagaggctgtcaacgtgctgcttcataggatgcccgagcttggctgtgtgcctgatgccttctcatactccattgttctgaagagcttatgtgacaacaacacgagtcagcgggggctgctccagatgatggcgaaagaaggaggtggctgctctcccaacgtggtggcatatagcacggtcatccatggcttcttcaaggaaggagaaacgggcaaggcatgcagtctgttccaccaaatgatgcagcaaggtgttgtgcccaatgtggtgacgtataactcgattattgatgcgttgtgtaaggctagagcaatggacaaggcagagctagtccttcggcagatggttgccaatggtgctcaacccaatgaagtgacatatacttgcatgatccatgggtattccacatctgggaggttgaaagaggctgctaaaatgttcagagaaatgaaaagccggggtcttacaccaaatactgttacctgcggctcgttaatgacttccctttgcaagcatggaagaagcaaagaagctagagaaatatttgattccatgactgccaaaggccacaaacctgatattgtctcgtaccgtattttgcttcatggttatgccagtgaaggatgctttgctgatatgattgatctatgtaattcaatggaaagcaacggtattgcagccgactgccgtgtttttaccatattaattgatgcctatgctaaacgtggaatgatggatgatgcaatgcacatatttacggaaatgcagcaacgaggtgtgagtccaaatgttgtcacatattcaactgtaatatcagcactttctagaatgggtaggctgaccgatgctatggaaaaatttaatcagatggttgccttgggagtacagccgaacatacctgtttattggtccctaattcagggcttttgtatgcatggtggtttggttaaagctaaggagttggtttctcaaatgataaacaaaggtattcctcgtcctaacattgtgttcttcaattcggtaataaacggtatgtgcaaggaaggaagggttatggatgcacatgatatctttgacttggttatagacctaggtgggaggcctgatgttattacatttaattcactgattgatggatattgcttggcccgcaagctggataaagcattcggaatgtttaattccatggaatcagttggtgttgagcctgatattgttacgtacagtacacttcttgatggctattttaaaaatagaaggatcaatgatggtttggctctgtttagagaaatgccgcgtaagagaattaaacctgacattgttacatatggcatcatgttggatgggttgtttcgtgctgggagaactgttgctgcaaggacaatgttccatgagatgatcgaaagtggaataacagtggacatccccacatataatatagttcttaggggactttgtagaaataactgcacagatgaagcaatcgccctgttccagaaattaggtgcaatgagtatgaagttcaatattgcaatactcaataccatgatcaatgcaatgtacaaggttcggagaagagaagaagctaacaatttgtttgctgcaatatcaaccagtgggttggtgcccaatcaatctacttatgcagtaatgataataaatcttctaaaagatggagcagtggaacatgctagcaatatgttttcatcaatggaaaaaagtggtatagtccccagctcccgtcttataaatggtatcatcagattgttgttggagaatggtgagattgccaaggctggaatttatttgtctaaagttgatgggaatagcatctcactcgaagcttcaactacttcattgatgttgtctctattttcaaggaaagggaaatatcatgaggacatgaaattgctcccagcaaagtatcaattttttgatggatgtagt

SEQ ID NO: 1641 - DNA, 2085 bp, Triticum aestivum; identical to SEQ ID NO: 1636

SEQ ID NO: 1642 - DNA, 2085 bp, Triticum aestivum
atggactgctgctgccgcgcgcgtcgcccagacctagggcttgccttattcggctgcatcctcaggacgggcttgaagatagaccaaatcaccgccaacaccctcctcaagtgcctctgctatgcaaaacagacagaagaggctgtgtacgtgctgcttcataggatgtcggagctcagctgtgtgcctgatgccttcgcatacaacatagttcttaagagcttatgtaaaggtagcaggagccagcgggcgcacgacctgctccggacgatggcaaaagatagaggtggctgcttccctgatgtggtgacatataccacggtcatccatggctttttcaaggagggcgaaacaggcaaggcatgcaatctattccatgaaatgatccatcaaggggttgagcccgatgtggcgacgtacaactcggttattgatgcgttgtgcaaggccagagcaatggacaaggctgaagtagtccttcagcagatggtcgataaaggtgttcaacctgatacagtgacatatacttgcatgatcaatggatattccacatctgggcggttgaaagaggctgctaaaatgttcagagaaatgaaaagccggggtcttataccagatattgttacttgcaactcgttcctggcctccatttgcaagcatggaacaagcaaagaagctgcagagtttttcgatgccatgactgccaagggccacaaaccgaatatcgtctcataccgtattttgcttcatgggtatgctactgaaggatgctttcctgatatgattgatgtctttaattcaatggaaagcaatggtattgcagccgactgccatgttttcaacatattaattgatgctaaacgtggaatgatggatgaagctatgctgatatcaagtaaaatgcaggaacgcagagtgaatcctgatgtagtcacctattccagcataatagctggactttccagattgggtaggctgactgaggccatggaaaaattcaatcagatgattgccttgggagtacaaccgaacaaagctgtttatcacgcgctgattcagggtttttgcatagatggtgatttggctaaagctaagcagttggtttatgaaatgatggacagaggtattcctcgtcctaacatttcgttctttagttcagtaataaagagtctctgccaagaaggaagggttatggatgcacatgatatctttgacttggttatagacatgggtgagaggcctgatggcattttatttaattcactgattgatggttactgcttagtcgggaagatggataaagcattaaaagtgcttgatgtcatggaatcagttggtgttgagcctgatgtttttacatacagtacacttgttaatggctattgtagaaatggaaggatcgatgatggtttgactctgttcagagagatgccgcgtaagagaattaaacctgacactgtttcatatcgcgtaataatggttgggttgtttcgtgctgggagaactgttgccgcaaggaaaatgttccatgagatgatcgagagtggaacaatggtggacattttcacatacaatataatactaggaggcctttgtagaaataattgtgcagacgaagcgatcgcactgttccagaaactacgagcaatgaatgtgaagtttgatattaccacactcaataccatgattaatgcaatgtacaacgttcaaagaaaagaagaagctaaggatttgtttgctacaatatcagccagtgggttggtgcctaatgaatctacttacagagtaatgataaaaaatcttctggaagaaggatcagtggaaaaagctgacagtatgttttcgttgatggacaagagtggtatagctcccagctctcgtctgttaaatgatattatcagaatgttgttggaaaaaggtgagatcaccaaggccggaaattatttgtctaaagttgatgggaagagcatctcacttgaagcttcaacgacttcattaatgttgtctctcttttcaagagaagggaaatatcgggaggacatgaaattgcttcctgcaaagtatcaatttttcgatggattttgt

SEQ ID NO: 1643 - DNA, 2085 bp, Triticum aestivum
atggactgctgctgccgcacgcgtcgcccagacctagggcttgccttattcggctgcatcctcaggacgggcttgaagatagaccaaatcaccgccaacaccctcctcaagtgcctctgctatgcaaaacagacagaagaggctgtgtacgtgctgcttcataggatgtcggagctcagctgtgtgcctgatgccttcgcatacaacatagttcttaagagcttatgtaaaggtagcaggagccagcgggcgcacgacctgctccggacgatggcaaaagatagaggtggctgcttccctgatgtggtgacatataccacggtcatccatggctttttcaaggagggcgaaacaggcaaggcatgcaatctattccatgaaatgatccatcaaggggttgagcccgatgtggcgacgtacaactcggttattgatgcgttgtgcaaggccagagcaatggacaaggctgaagtagtccttcagcagatggtcgataaaggtgttcaacctgatacagtgacatatacttgcatgatcaatggatattccacatctgggcggttgaaagaggctgctaaaatgttcagagaaatgaaaagccggggtcttataccagatattgttacttgcaactcgttcctggcctccatttgcaagcatggaacaagcaaagaagctgcagagtttttcgatgccatgactgccaagggccacaaaccgaatatcgtctcataccgtattttgcttcatgggtatgctactgaaggatgctttcctgatatgattgatgtctttaattcaatggaaagcaatggtattgcagccgactgccatgttttcaacatattaattgatgctaaacgtggaatgatggatgaagctatgctgatatcaagtaaaatgcaggaacgcagagtgaatcctgatgtagtcacctattccagcataatagctggactttccagattgggtaggctgactgaggccatggaaaaattcaatcagatgattgccttgggagtacaaccgaacaaagctgtttatcacgcgctgattcagggtttttgcatagatggtgatttggctaaagctaagcagttggtttatgaaatgatggacagaggtattcctcgtcctaacatttcgttctttagttcagtaataaagagtctctgccaagaaggaagggttatggatgcacatgatatctttgacttggttatagacatgggtgagaggcctgatggcattttatttaattcactgattgatggttactgcttagtcgggaagatggataaagcattaaaagtgcttgatgtcatggaatcagttggtgttgagcctgatgtttttacatacagtacacttgttaatggctattgtagaaatggaaggatcgatgatggtttgactctgttcagagagatgccgcgtaagagaattaaacctgacactgtttcatatcgcgtaataatggttgggttgtttcgtgctgggagaactgttgccgcaaggaaaatgttccatgagatgatcgagagtggaacaatggtggacattttcacatacaatataatactaggaggcctttgtagaaataattgtgcagacgaagcgatcgcactgttccagaaactacgagcaatgaatgtgaagtttgatattaccacactcaataccatgattaatgcaatgtacaacgttcaaagaaaagaagaagctaaggatttgtttgctacaatatcagccagtgggttggtgcctaatgaatctacttacagagtaatgataaaaaatcttctggaagaaggatcagtggaaaaagctgacagtatgttttcgttgatggacaagagtggtatagctcccagctctcgtctgttaaatgatattatcagaatgttgttggaaaaaggtgagatcaccaaggccggaaattatttgtctaaagttgatgggaagagcatctcacttgaagcttcaacgacttcattaatgttgtctctcttttcaagagaagggaaatatcgggaggacatgaaattgcttcctgcaaagtatcaatttttcgatggattttgt

SEQ ID NO: 1644 - DNA, 2085 bp, Triticum aestivum; identical to SEQ ID NO: 1642

SEQ ID NO: 1645 - DNA, 1758 bp, Triticum aestivum
atggctttttcaaggagggcgaaacaggcatgcaatctattccatgaaatgatccatcaaggggttgagcccgatgtggcgacgtacaactcggttattgatgcgttgtgcaaggccagagcaatggacaaggctgaagtagtccttcagcagatggtcgataaaggtgttcagcctgatacagtgacatatacttgcatgatcaatggatgttccacatctgggcggttgaaagaggctgctaaaatgttcagagaaatgaaaagccggggtcttataccagatattgttacttgcaactcgttcctggcctccatttgcaagcatggaacaagcaaagaagctgcagagtttttcgatgccatgactgccaagggccacgaaccgaatatcgtctcataccgtattttgcttcatgggtatgctactgaaggatgctttcctgatatgattgatgtctttaattcaatggaaagcaatggtattgcagccgactgccatgttttcaacatattaattgatgcatatgctaaacgtggaatgatggatgaagctatgctgatatcaagtaaaatgcaggaacgcagagtgaatcctgatgtagtcacctattccagcataatagctggactttccagattgggtaggctgactgaggccatggaaaaattcaatcagatgattgccttgggagtacaaccgaacaaagctgtttatcacgcgctgattcagggtttttgcatagatggtgatttggctaaagctaagcagttggtttctgaaatgatgaacagaggtattcctcgtcctaacatttcgttctttagttcagtaataaagagtctctgccaagaaggaagggttatggatgcacatgatatctttgacttggttatagacatgggtgagaggcctgatggcattttatttaattcactgattgacggttactgcttagtcgggaagatggataaagcattaaaagtgcttgatgtcatggaatcagttggtgttgagcctgatgtttttacatacagtacacttgttaatggctattgtagaaatggaaggatcgatgatggtttgactctgttcagagagatgccacgtaagagaattaaacctgacactgtttcatatcgcgtaataatggttgggttgtttcgtgctgggagaactgttgccgcaaggaaaatgttccatgagatgatcgagagtggaacaatggtggacattttcacatacaatataatactaggaggcctttgtagaaataattgtgcagacgaagcgatcgcactgttccagaaactacgagcaatgaatgtgaagtttgatattaccacactcaataccatgattaatgcaatgtacaacgttcaaagaaaagaagaagctaaggatttgtttgctacaatatcagccagtgggttggtgcctaatgaatctacttacagagtaatgataaaaaatcttctggaagaaggatcagtggaaaaagctgacagtatgttttcgttgatggacaagagtggtatagctcccagctctcgtctgttaaatgatattatcagaatgttgttggaaaaaggtgagatcgccaaggccggaaattatttgtctaaagttgatgggaagagcatctcacttgaagcttcaacgacttcattaatgttgtctctcttttcaagagaagggaaatatcgggaggacatgaaattgcttcctgcaaagtatcaatttttcgatggattttgt

SEQ ID NO: 1646 - DNA, 2085 bp, Triticum aestivum; identical to SEQ ID NO: 1643

SEQ ID NO: 1647 - DNA, 2085 bp, Triticum aestivum; identical to SEQ ID NO: 1642

SEQ ID NO: 1648 - DNA, 2085 bp, Triticum aestivum; identical to SEQ ID NO: 1643

SEQ ID NO: 1649 - DNA, 2376 bp, Triticum aestivum
atggtcttcccacgccgcatttgccgcggccacggagcgcgtccgcgccgggacgctcagaccggaggacgcacaccacctgttcgaccaattgctacaacagaccacccgggtccacgagcgctccctgcatggatattcctcgccgcccttgcccgtgctacgccctccgcagcctgcaaagatggcccctccctcgccctcgccctcttcaaccgcgtatgccgagaagaagcaggccggcgggtggcgccgcccacagtccatacatacggcatcctgatgaactgctgctgccttgtgcgtcgtccagacctagggcttgccttatttggccgcctcctaaggacagggctcaaaacaaatgagatcgtcgccagcaccatcctcaagtgcctctgctgcgcaaaacggacagatgaagcagtaaacgtgttgcttcataggatgtccgacctcggctgtgtgcctaatgtgttctcatacaacagagttctaaagagcttgtgtgaagatggcaggagccagcgggcgctcgacctgctccgggtgatggcaaaaggagatggagatggctgctccccctgcgtggtgtcatacagcacggtcatctatggcttctttaaggaaggcaaagtaggcaaggcatgcaatctatttcatgaaatgacgcagcaaggcattgtgtctgatgtggtgacgtataactcaattatcgatgcactgtgcaaggccagagctatggacaaggctgagctgttccttcggcagatggttgatgatgatattcgaccgaatggagtgacatatactgcaattatccatggatattccactttgggccagtggaaaaaggcgactcaaatgtttagagaaatgacaagccgcggtcttgtaccaaatactgtcacttggaactcattcatggcctccctctgcaagcatggaagaagcaaagaagttgcagaacttctttattccatggctgtgaagggccacaagcctaatgtcgtatcctactctattttgcttcatgggtatgcaaccgaagggtgctttgctgatatggttaatctctttaattcaatggtaggcaaaggtattgtaccggaccaccatgttttcaacatattcattaatgcatatgctaagtgtgggatgatggatgaagctatgcatatgttgactgaaatgcgggaacaaggaatgagtccggatatgtgcacctatgcaaccataatagctgcactttgcagaatgggtaggctggctgatgctgtggacaattttaatcagatgattgggaagggagtacagccaagcaaagttgtttatcgctccttaattcagggattctgtacacacggtgatttggtgaaagcgaaggagttcatttctgaaatgacggacaaatgtatttgtcgtcctaccattgtcttcttcagttcaataatgcatagtctgtgcaacgaaggaagggtcatagatgcgcaccatatctttgacttggttatagacattggtgagagacctgatctcattgcatttaatactctgattgacggatattgcttagtcggcaacatggagaaagcactcggtgtacttgattccatggtatcagctggcattgagcctactgttgttacatatagctcacttattagtgggtattgtaagagtggaaggctcgatgatggtgttattctattcagagaaatggagcataagagagttaaacctgacactgttacatataacatcatactggatgggttatttcatgctgggggaacaattgctgcaaagaagttgttcaatgagatggttgaaagtggaacagtagtgagcatttccacatacaggatagtccttggaggactttgtaggaataattgcaccaatgaagcaatcgtcttgttccagaaattaggtgcaatgaatgtgaagttcgatattgcaatactcaataccatgattaatgcaatgtacaaggttcagagaagagaagaagctaacgatttgtttgcttcattaccagcctgtgggctggtacctaatgcctctacttacggagtagtaatacagaatcttctgaaagaaggaccgttggaagaagctgacaatatgttttcatcaatggagaagagtggttgtgttcccagctctcgtcttataaatgatatcatcagaacgttattggaaaagggggaaatagtcaaggcagcaaattatatgtctaaaattgatgggaagatcatttcttttgaagcttcaaccacttcgttgatgttgtctctcttttcggagaaaggcaaataccaggaacaattacaattgctccctgcgaaataccatttctttggtggagtcatt

SEQ ID NO: 1650 - DNA, 2376 bp, Triticum aestivum; identical to SEQ ID NO: 1649

SEQ ID NO: 1651 - DNA, 2376 bp, Triticum aestivum; identical to SEQ ID NO: 1649

SEQ ID NO: 1652 - DNA, 2376 bp, Triticum aestivum; identical to SEQ ID NO: 1649

SEQ ID NO: 1653 - DNA, 2376 bp, Triticum aestivum; identical to SEQ ID NO: 1649

SEQ ID NO: 1654 - DNA, 2376 bp, Triticum aestivum; identical to SEQ ID NO: 1649

SEQ ID NO: 1655 - DNA, 2646 bp, Triticum aestivum
atgcccagccgcatcccgccgccgatgccccgccgcatatgcgtctggctccgctgctcctccccatcctcatcctgcacctatcccgactccggtctccgccacccgtcctgccttacctctccgttgtccggcctccgcctccgccgctccttcaccactccgatgtcgaacctccgcctccgctgctccttcaccactccgatgtcgaacctccgcctcttccgccgcagctcctcctccacctccacccccacctcgccgtcctcacgttcatggtctccccacgcagcctttgccgcggccacagagcgcgtccgcgccgggacgctgaaccaagacgacacacacaacctgtttgacgaattgctgcggcaggccatcccggtccccgggcgctccctgaacggcttcctcgccgccctcgcacgtgctacctcctctgccgcctgcatcagagatggccctgccctcaccgtcgccctcttcaaccgcgtgtgccgggagcaagccggcccgcgggtggcgcctctcacagtccacacgtacaacatcctcatggactgctgctgccgcgcgtctcgcccggacctaggtcttgccttcttcggccgcctcctcaggacgggcctcaagacaaatgagatcgttgccaccaccttcctcaagtgcctctgctacgcaaaacggacggatgaggctgtgaacgtgctgcttcataggatgcccgagctcggctgtgtgcctgacgccttcgcatactccactgttctgaagagcttatgcgacaatagcatgagtcagcgggggctcgacctgctccatatgatggcgaaagaaggaggtggctgctcccccaacgtggtggcgtatagcaccgtcatccatggcttctttaaggaaggtgaaacaggcaaggcatgcaatctgttccatgaaatgatgcagcaaggtgttgagcccaatgtgtggacatatagttcaatcattgatgcattgtgcaaggccagagcaatggacaaggcagagctagtgcttcagcagatggttaacaaaggtgttcaacccaataatgtgacatataattgcatgatccatggatattccacatctgggtggtggaaagaggttgttaaattgtttagagaaatgaaaagccggggccttataccagatatttttacttgcaactccttaatgacttacctttgtaagcatggaagaagcaaagaagctgcagaattttttgacgccgtgactgccaaaggccacagagatgtcatctcctactgtattttgcttcatgggtatgccaatgaaggatgctttgctgatatgattgatctctttaattcaatgcaaagaaacggtattgctgccaactgccatgttttcaacatattaattaatggatatgctaaacgtggaatgacggaagaagctatgctgatatttacaaaaatgtgggaaaaaggagtgagtccagatgtagtcacctattccatagtaatagccgcactttccagaatggggaggttgaccgacgctatggaaaaatttaatcagatgattgccatgggaattcagccaaacacagccgtttatcactccctaattcagggtttttgcatagacggtgatttggttaaagccaagcagctggtttctgaaatgatgaacagaggtattcctcgtccaaacattgtgttcttcaattcagtaataaacagtctgtgcaaagaaggaagggtcatggatgcacatgatgtcttagacttggttgtaggcataggtgagaggcctaatgtcattacatttagttcactgattgacggatattgctcagtcgggaacatggataaagcattcaaaatacttgatgtcatggaatcagttggtgttgagcctaatgttgttacttatagtgcacttcttgatggctattctaaaaacagaaggattgatgatgctctgactttgtttagagaaatgccgcgtaagagaattaaacctgacactgttacatgtggcatcatgttggatgggttgtttcgtgctgggagaactgtcgctgcaatggaaatgttccatgagatgactgaaagtggaacaacagtggacattttcatatacaatataatacttggaggtctttgtagaaataattgtgtagatgaagcgattgcactgttccagaaattgcgagcaatgaatgtgaagttcaatattgaaatactcaataccatgattaatgcaatgtacaaggttcaaagaaaggaagaagcaaaggaattgtttgctacaatatcagccaatgggttggtgcccaatgaatctacttatgcagtaatgataagaaatcttctgaaagacggagcagtggaagatgctgacaatatgttttcatcaatggacaacagtggtatcgttcccagttcccgtcttataaatgatatcatcagaatgttgttggaaaaaggtgagatagccaaggctggaaattatttgtctaaagttgatgggaagagtatctcacttgaagcttcaactacctcattgatgttgtctctcttttcaaggaaagggaaacaccaggaggatattaagttgctccctgcaaagtatcaaatttttgatggatttagt

SEQ ID NO: 1656 - DNA, 1632 bp, Triticum aestivum
atggacaaggcagagctagtgcttcagcagatggttaacaaaggtgttcaaccgaataatgtgacatataattgcatgatccatggatattccacatctgggtggtggaaagaggttgttaaattgtttagagaaatgaaaagccggggccttataccagatatttttacttgcagctccttaatgacttacctttgtaagcatggaagaagcaaagaagctgcagaattttttgacgccgtgactgccaaaggccacagagatgtcatctcctactgtattttgcttcatgggtatgccaatgaaggatgctttgctgatatgattgatctctttaattcaatgcaaagaaacggtattgctgccaactgccatgttttcaacatattaattaatggatatgctaaacgtggaatgacggaagaagctatgctgatatttacagaaatgtgggaaaaaggagtgagtccagatgtagtcacctattccatagtaatagccgcactttccagaatggggaggttgaccgacgctatggaaaaatttaatcagatgattgccatgggaattcagccaaacacagccgtttatcactccctaattcagggtttttgcatagacggtgatttggttaaagccaagcagctggtttctgaaatgatgaacagaggtattcctcgtccaaacattgtgttcttcaattcagtaataaacagtctgtgcaaagaaggaagggttatggatgcacatgatgtcttagacttggttataggcataggtgagaggcctaatgtcattacatttaattcactgattgacggatattgcttagtcgggaacatggataaagcattcaaaatacttgatgtcatggaatcagttggtgttgagcctaatgttgttacttatagtgcacttcttgatggctattctaaaaacagaaggattgatgatgctctgactttgtttagagaaatgccgcgtaagagaattaaacctgacactgttacatatggcatcatgttggatgggttgtttcgtgccgggagaactgtcgctgcaatggaaatgttccatgagatgactgaaagtggaacaacagtggacattctcatatacaatataatacttggaggtctttgtagaaataattgtgtagatgaagcgattgcactgttccagaaattgcgagcaatgaatgtgaagttcaatattgaaatactcaataccatgattaatgcaatgtacaaggttcaaagaaaggaagaagcaaaggaattgtttgctacaatatcagccaatgggttggtgcccaatgaatctacttatgcagtaatgataagaaatcttctaaaaggcggagcagtggaagatgctgacaatatgttttcatcaatggacaacagtggcatcgttcgcagttctggtcttataaatgatatcatcagaatgttgttgaaaaaaggtgagatagccaaggctggcaattatttgtctaaagttgacgggaagagtatctcacttgaagcttcaactacctcattgttgttgtctctcttttcaaggaaagggaaacatcaggtggatattaagttgctccctgcaaagtatcaattttttgatggatttggt

SEQ ID NO: 1657 - DNA, 1632 bp, Triticum aestivum; identical to SEQ ID NO: 1656

SEQ ID NO: 1658 - DNA, 1632 bp, Triticum aestivum; identical to SEQ ID NO: 1656

SEQ ID NO: 1659 - DNA, 657 bp, Triticum aestivum
atgccgcgtaagagaattaaacctgacactgttacatatggcatcatgttggatgggttgtttcgtgctgggagaattgtcgctgcaatggaaatgttccatgagatgactgaaagtggaacaacagtggatattctcatatacaatataatacttggaggtctttgtagaaataattgtgtagatgaagcgattgcactgttccagaaattgcgagcaatgaatgtgaagttcaatattgaaatactcaataccatgattaatgcaatgtacaaggttcaaagaaaggaagaagcaaaggaattgtttgctacaatatcagccaatgggttggtgcccaatgaatctacttatgcagtaatgataagaaatcttctgaaagacggagcagtggaagatgctgacaatatattttcatcaatggacaacagtggtatcgttcccagttcccgtcttataaatgatatcatcagaatgttgttggaaaaaggtgagatagccaaggctggaaattatttgtctaaagttgatgggaagagtatctcacttgaagcttcaactacctcattgatgttgtctctcttttcaaggaaagggaaacatcaggaggatattaagttgctccctgcaaagtatcaattttttgatgggtttggt

SEQ ID NO: 1660 - DNA, 2367 bp, Triticum aestivum
atggtctccccgcgacgcctttgccgcggccacggagcgcgtccgtgccgggacgctcagcccggaggacgcacaccacctgttcaaccaattgctacggcaggacactccggtccacgagcgctccctgggcggcttccttgccgccctcgcccgtgcgccagactcagctgcctgcagagatggccccgccctcgccatcgccctcttcaaccgcgtatgccgagaagaagcaggccggccggtggtgccgcccacagtctacacctacgccatcctgatgaactgctgctgccgcgtgcgtcgtccggacctagggcttgccttatttggccgcctcctaaggacaggcctcaaacaaatgagatcgtcgccagcaccgtcctcaagtgcctctgctgcgcaaaacggacagatgaagcagtaaacgtgctgattcataggatgtccgacctcggctgtgtgccaaatgagttctcatacaaaacagttctgaagagcctgtgtgaagatagcaggagccagcgagcgctcgatctgctccgggtgatggcaaaaggagatggctgctccccctgcgtggtgtcatacagcactgtcatctatggcttctttaaggaaggaaaagtaggcaaggcatgcaatctatttcatgaaatgacgcagcaaggcgttgtgtctgatgtggtgacatataactcaattatcgatgcactgtgcaaggccagagctatggacaaggctgagctattccttcggcagatggttgatgatgatattcgaccgaatggagtgacatataatgcaatgatccatggatattccactttgggccagtggaaaaaggcgactcaaatgtttagagaaatgacaagccgcggtcttgtaccagatactgtcacttggaactcatgcatggcctccctctgcaagcatggaagaagcagagaagctgcagaacttctttattccatggctgcgaagggccacaagcctaatgtcgtatcctactctactttgcttcatgggtatgcaaacgaagggtgctttgctgatatggttaatctctttaattcaatggtaggcaaaggtattgtaccggaccaccatgttttcaacatattcattaatgcatatgctaagtgtgggatgatggatgaagttatgcatatgttgactgaaatgcgggaacaaggaatgagtccggatgtgtgcacctatgcaaccataatagctgcactttgcagaatgggtaggctggctgatgctgtggacaattttaatcagatgattgggaagggagtacagccaagcaaagttgtttatcgctccttaattcagggattctgtacacacggtgatttggtgaaagcgaaggagttcatttttgaaatgacggacaaatgtatttgtcgtcctaccattgtcttcttcaattcaataatgcatagtctgcgcaacgaaggaagggtcatagatgcgcaccatatctttgacttggttatagacattggtgagagacctgatctcattgcatttaatactctgattgatggatattgcttagtcggcaacatggagaaagcactcggtgtacttgattccatggtatcagctggcattgagcctactgttgttacatatagctcacttattagtgggtattgtaagagtggaaggctcgatgatggtgttattctattcagagaaatggagcataagagagttaaacctgacactgttgcatataacatcatactggatgggttatttcatgctggggcaacaattgctgcaaagaagttgttcaatgagatgattgaaagtggaacagcagtgagcatttccacatacaggatagttcttggaggattttgtaggaataattgcaccgatgaagcgatcgtcttgttccagaaattaggtgcaatgaatgtgaagttcgatattgcaatactcaataccatgattaatgcaatgtacaaggttcagagaagagaagaagctaacgatttgtttgcttcattaccagcctgtgggctcgtacctaatgcctctacttacggagtagtaatacagaatcttctgaaagaaggatcgttggaagaagctgacaatatgttttcatcaatggagaagagtggttgtgctcccagctctcgtcttataaattatatcatcagaacgttgttggaaaagggggagatagtcaatgcagcaaattatatgtctaaagttgatgggaagatcatctcttttgaagcttcgaccacttcgttgttgttgtctctcttttcggagaaaggcaaatatcaggaacaattacaattgctccctgcgaaataccaattctttggtggagtcatt

SEQ ID NO: 1661 - DNA, 2148 bp, Triticum aestivum
atgccgagaagaagcaggcaggccggtggtgccgcccacagtctacacctacgccatcctgatgaactgctgctgccgcgtgcgtcgtccggacctagggcttgccttatttggccgcctcctaaggacaggcctcaaacaaatgagatcgtcgccagcaccgtcctcaagtgcctctgctgcgcaaaacggacagatgaagcagtaaacgtgctgattcataggatgtccgacctcggctgtgtgccaaatgagttctcatacaaaacagttctgaagagcctgtgtgaagatagcaggagccagcgagcgctcgatctgctccgggtgatggcaaaaggagatggctgctccccctgcgtggtgtcatacagcactgtcatctatggcttctttaaggaaggaaaagtaggcaaggcatgcaatctatttcatgaaatgacgcagcaaggcgttgtgtctgatgtggtgacatataactcaattatcgatgcactgtgcaaggccagagctatggacaaggctgagctattccttcggcagatggttgatgatgatattcgaccgaatggagtgacatataatgcaatgatccatggatattccactttgggccagtggaaaaaggcgactcaaatgtttagagaaatgacaagccgcggtcttgtaccagatactgtcacttggaactcatgcatggcctccctctgcaagcatggaagaagcagagaagctgcagaacttctttattccatggctgcgaagggccacaagcctaatgtcgtatcctactctactttgcttcatgggtatgcaaacgaagggtgctttgctgatatggttaatctctttaattcaatggtaggcaaaggtattgtaccggaccaccatgttttcaacatattcattaatgcatatgctaagtgtgggatgatggatgaagttatgcatatgttgactgaaatgcgggaacaaggaatgagtccggatgtgtgcacctatgcaaccataatagctgcactttgcagaatgggtaggctggctgatgctgtggacaattttaatcagatgattgggaagggagtacagccaagcaaagttgtttatcgctccttaattcagggattctgtacacacggtgatttggtgaaagcgaaggagttcatttttgaaatgacggacaaatgtatttgtcgtcctaccattgtcttcttcaattcaataatgcatagtctgtgcaacgaaggaagggtcatagatgcgcaccatatctttgacttggttatagacattggtgagagacctgatctcattgcatttaatactctgattgatggatattgcttagtcggcaacatggagaaagcactcggtgtacttgattccatggtatcagctggcattgagcctactgttgttacatatagctcacttattagtgggtattgtaagagtggaaggctcgatgatggtgttattctattcagagaaatggagcataagagagttaaacctgacactgttgcatataacatcatactggatgggttatttcatgctggggcaacaattgctgcaaagaagttgttcaatgagatgattgaaagtggaacagcagtgagcatttccacatacaggatagttcttggaggattttgtaggaataattgcaccgatgaagcgatcgtcttgttccagaaattaggtgcaatgaatgtgaagttcgatattgcaatactcaataccatgattaatgcaatgtacaaggttcagagaagagaagaagctaacgatttgtttgcttcattaccagcctgtgggctcgtacctaatgcctctacttacggagtagtaatacagaatcttctgaaagaaggatcgttggaagaagctgacaatatgttttcatcaatggagaagagtggttgtgctcccagctctcgtcttataaattatatcatcagaacgttgttggaaaagggggagatagtcaatgcagcaaattatatgtctaaagttgatgggaagatcatctcttttgaagcttcgaccacttcgttgttgttgtctctcttttcggagaaaggcaaatatcaggaacaattacaattgctccctgcgaaataccaattctttggtggagtcatt

SEQ ID NO: 1662 - DNA, 2367 bp, Triticum aestivum; identical to SEQ ID NO: 1660

SEQ ID NO: 1663 - DNA, 2367 bp, Triticum aestivum
atggtctccccgcgacgcctttgccgcggccacggagcgcgtccgtgccgggacgctcagcccggaggacgcacaccacctgttcgaccaattgctacggcaggacactccggtccacgagcgctccctgggcggcttccttgccgccctcgcccgtgcgccagactcagctgcctgcagagatggccccgccctcgccatcgccctcttcaaccgcgtatgccgagaagaagcaggccggccggtggtgccgcccacagtctacacctacgccatcctgatgaactgctgctgccgcgtgcgtcgtccggacctagggcttgccttatttggccgcctcctaaggacaggcctcaaacaaatgagatcgtcgccagcaccgtcctcaagtgcctctgctgcgcaaaacggacagatgaagcagtaaacgtgctgattcataggatgtccgacctcggctgtgtgccaaatgagttctcatacaaaacagttctgaagagcctgtgtgaagatagcaggagccagcgagcgctcgatctgctccgggtgatggcaaaaggagatggctgctccccctgcgtggtgtcatacagcactgtcatctatggcttctttaaggaaggaaaagtaggcaaggcatgcaatctatttcatgaaatgacgcagcaaggcgttgtgtctgatgtggtgacatataactcaattatcgatgcactgtgcaaggccagagctatggacaaggctgagctattccttcggcagatggttgatgatgatattcgaccgaatggagtgacatataatgcaatgatccatggatattccactttgggccagtggaaaaaggcgactcaaatgtttagagaaatgacaagccgcggtcttgtaccagatactgtcacttggaactcatgcatggcctccctctgcaagcatggaagaagcagagaagctgcagaacttctttattccatggctgcgaagggccacaagcctaatgtcgtatcctactctactttgcttcatgggtatgcaaacgaagggtgctttgctgatatggttaatctctttaattcaatggtaggcaaaggtattgtaccggaccaccatgttttcaacatattcattaatgcatatgctaagtgtgggatgatggatgaagttatgcatatgttgactgaaatgcgggaacaaggaatgagtccggatgtgtgcacctatgcaaccataatagctgcactttgcagaatgggtaggctggctgatgctgtggacaattttaatcagatgattgggaagggagtacagccaagcaaagttgtttatcgctccttaattcagggattctgtacacacggtgatttggtgaaagcgaaggagttcatttttgaaatgacggacaaatgtatttgtcgtcctaccattgtcttcttcaattcaataatgcatagtctgcgcaacgaaggaagggtcatagatgcgcaccatatctttgacttggttatagacattggtgagagacctgatctcattgcatttaatactctgattgatggatattgcttagtcggcaacatggagaaagcactcggtgtacttgattccatggtatcagctggcattgagcctactgttgttacatatagctcacttattagtgggtattgtaagagtggaaggctcgatgatggtgttattctattcagagaaatggagcataagagagttaaacctgacactgttgcatataacatcatactggatgggttatttcatgctggggcaacaattgctgcaaagaagttgttcaatgagatgattgaaagtggaacagcagtgagcatttccacatacaggatagttcttggaggattttgtaggaataattgcaccgatgaagcgatcgtcttgttccagaaattaggtgcaatgaatgtgaagttcgatattgcaatactcaataccatgattaatgcaatgtacaaggttcagagaagagaagaagctaacgatttgtttgcttcattaccagcctgtgggctcgtacctaatgcctctacttacggagtagtaatacagaatcttctgaaagaaggatcgttggaagaagctgacaatatgttttcatcaatggagaagagtggttgtgctcccagctctcgtcttataaattatatcatcagaacgttgttggaaaagggggagatagtcaatgcagcaaattatatgtctaaagttgatgggaagatcatctcttttgaagcttcgaccacttcgttgttgttgtctctcttttcggagaaaggcaaatatcaggaacaattacaattgctccctgcgaaataccaattctttggtggagtcatt

SEQ ID NO: 1664 - DNA, 1170 bp, Triticum aestivum
atgagtccggatgtgtgcacctatgcaaccataatagctgcactttgcagaatgggtaggctggctgatgctgtggacaattttaatcagatgattaggaagggagtacagccaagcaaagttgtttatcgctccttaattcagggattctgtacacacggtgatttggtgaaagcgaaggagttcatttttgaaatgacggacaaatgtatttgtcgtcctaccattgtcttcttcaattcaataatgcatagtctgtgcaacgaaggaagggtcatagatgcgcaccatatctttgacttggttatagacattggtgagagacctgatctcattgcatttaatactctgattgatggatattgcttagtcggcaacatggagaaagcactcggtgtacttgattccatggtatcagctggcattgagcctactgttgttacatatagctcacttattagtgggtattgtaagagtggaaggctcgatgatggtgttattctattcagagaaatggagcataagagagttaaacctgacactgttgcatataacatcatactggatgggttatttcatgctggggcaacaattgctgcaaagaagttgttcaatgagatgattgaaagtggaacagcagtgagcatttccacatacaggatagttcttggaggattttgtaggaataattgcaccgatgaagcgatcgtcttgttccagaaattaggtgcaatgaatgtgaagttcgatattacaatactcaataccatgattaatgcaatgtgcaaggttcagagaagagaagaagctaacgatttgtttgcttcattaccagcctgtgggctcgtacctaatgcctctacttacggagtagtaatacagaatcttctgaaagaaggatcgttggaagaagctgacaatatgttttcatcaatggagaagagtggttgtgctcccagctctcgtcttataaattatatcatcagaacgttgttggaaaagggggagatagtcaatgcagcaaattatatgtctaaagttgatgggaagatcatctcttttgaagcttcgaccacttcgttgttgttgtctctcttttcggagaaaggcaaatatcaggaacaattacaattgctccctgcgaaataccaattctttggtggagtcatt

SEQ ID NO: 1665 - DNA, 2148 bp, Triticum aestivum; identical to SEQ ID NO: 1661

SEQ ID NO: 1666 - DNA, 2367 bp, Triticum aestivum; identical to SEQ ID NO: 1660

SEQ ID NO: 1667 - DNA, 2274 bp, Triticum aestivum
atgccaaccgcccgcctgtcctccatcttcacctcctccttcaaggctccttcacgagagcgccgagctcccctcgccgccttggctgctgccacggagcgtgtgcgcgccggaacgctaagccaggaggacgcgcaccacctgttcgacgaattgctgagccaagccgccaccgtcccagtacgcgggctcaacaactttcttgctgcgctagctcgtgcaccgcccggactgctgtaccgaggcgctggtgcacgggtggtgtcgcccacgtgctgtacctattccatcctcatggactgctgctgccgtgcaggccgcccggacttggtgcttgccttcttcggccgcctcctcaggttggggctgcgctttgaggaggtcatccccttcaacaacctcctcaaggggctctgccaggccaagcgttcaaatgaggctttggacatgctgctccaccggatgcccgaactggactgtgcgcctgatgtcttctcgttcaacatagtaatcaacggctgctttaaagaaggtgaagtagacaaagcgtgcaatctcttccatgagatgccccaactgggagttcaacctgatgtggtcacctacacctcaatcatggacgcactaagcaagtccggagcaatggacaaggcagaagtgctccttcggcaaatggttgatcaaggaattgaacccaatatcattacgtatactagtctgatccatggatattccacttcgggtcagtggaaagcagcagttaggatattcaaagaaatggcaagtgctggtgttcgaccaaattctgtcacgttgaactcatttattgattccctttgcaagcatagaaagacaaaggaagctagagatatttttgactccatggccgcaaagggccacaaacctgatattttctcctactctactatgcttaattggtatgcgaaagaaggatgcttcgatgatatgactgatctcttcaattcgatggtacggaatggtatcgtacctgaccaccatgttttcaacatactgatcaatgcatatgctagacgtggactgatggataaggctatgcacatgttcgaagtaatgaggcaacaaggagtaaacccaaatgtagttgactatgtagtagtaatggattcactttgcaaaatgggcaagatggctgctgctatggatatatttaatcagatggtcaatcaaggagtttcacctaacaaagctgtttaccaatgcctggttctgggttcttgctctcatggtcattttgtgaaagccaaggaattgatttctgaagcggttaatagaggtctgtgttctaacagtgtgttcttctatcctgtaataaacgaccgttgcaaagaaggaaaggtgaaggaggcacaggatatgtttgacttcattgtaggtattggtcatcggcctcatgtgattatgtacaattcactgatggatggatattgccttgttggcaaggtggaggaagcactgagagtacttgatgctatgaagtctgctggcctccaacctgatctttttacatatggtatacttattaatggctactgtaaaattggaaggatcgacgagggattgagtcttgtcagggaaatttcactcagtggggttaagcccacgactattatgtacaacattatacttgatgggctgttttgctctgggagaacagttcctgcaaaggaaaaattccataagatgaatgaaagtggcataccagtgggcgttggaacatacaacatagttcttagtggactttgtaaaaataattgcactgatgaagcaatagagctgttcaagaaattacgtgctgtgaacgtgaagattaatgtcataacactcactaccatgatttctgcaatgtttaaaactaggagaattgaagaagccaaggatttgtttgctgctatatcagccattgggttggtgccttctgttgtgacttacagtataacgatgacaaatttcataaaagaagggttgcttgcagatgctgatgatatgttttcagcaatggagaaggctggctgtgctcacaactccagactgctaaatcaagtggtcagggtatttctgaagaatggtgaagttgtaaaggctgtgacttatcttgccaaacttgatgcaaaacagctgtcagttgaagcttcgacggtttcgttaatagtatctctcttctcaaggaaagggaaattaagggagcatgtaaaattgcttccggtaaagtaccagcctcctgagatgttggac

SEQ ID NO: 1668 - DNA, 2304 bp, Triticum aestivum
atgccaaccgcccgcctgtcctccatctccacctcctccttcagggctccttcacgagcccccctcgccgccttggctgccgccacggaacgcgttcgtgctggaacactaagccgggaggacgcgcaccacctgttcgacgaattgctaggccaagccgcccccgtcccggaacgagggctgaacaactttcttgccgcactagcccgtgctccgccctcatctgcctacagcgatggccccggccttgccatcgccctcttcaaccgcatgtcccgatgcgctggtgcacgggtggtgtcgcccacgctctgtacctattccatcctcatggactgctgctgccgcgcaggctgccgggagctggtggttgccttctttggccgcctcatcaagttggggctgcgcttgaatgtcatccccttcaacaacctcctcaaggggctctgccaggccaagcgtacaaatgaggcggtggacttgctgctccaccggacacctgaactggactgtgtgcctaatgtcttctcgtacagcatcgtaatcaacggctgttttaaacaaggtgaagtagacaaagcgtgcaatctcttccatcagatgatccaactgggagttcaacctaatttggtgacctacaactcaatcatcgacgcactaagcaaatccggagcaatggacaaggcagaagtagtccttcggcaaatggttgatcaaggcattggaccaaacgtcatgacatatactagtctgatccatggatattccacttcaggtcagtggaaggaggcagttaggttattcaagaaaatgataggtcttggtgctctaccagataccgtcatgtggaactcatttatggattcactttgcaagcatagaaggacaaaggatgctagagatatttttgactccatggctgcaaagggccaaaaacctgatattttctcctactctattatgctaaatgggtatgctaaagaaggatacttcgaggatatgactgatctcttcaatttgatggtacggaatggtattgtacctaaccaccatgttttcaacatactgatcaatgcatatgctaaacgtggactgatggatgaggctatgcacatgttcgaagtaatgaggcaacaaggagtaaacccaaatgtagactatctagtaataatggattcactttgtaaaatgggtaggatggatgctgctctggacaaatttaatcagatggtcaatcaaggagtttcacctaacaaagctgtttaccaatgcctggttctgggttcttgctctcatggtcattttgtgaaagccaaggaattgatctctgaagcaattaatagaggtctgttttctaacagtgtgttcttctatcctgtaataaacgacctgtgcaaagaaggaaaggtgaaggaggcacaggatatgtttaacttcattgtaggtattggtcagcggcctgatgtgattatgtacaattcactgatggatggatattgccttgttggcaaggtggaggaagcactgagagtacttgctgctatgaagtctgctggcctccaacctactgctgttacatacggtatacttcttaatggctactgtaaaagtggaaggattgctgctgggttgagtcttttcatggaaatgtcactcagcggggttaagcccactactattatgtacaacattatacttgatgggctgttttgctctgggagaacagtttctgcaaaggaagaattcgatacgatgattgaaagtggcataccagtgaacgttcgcacatacaacatagttcttagtggactttgtagaaacaattgcactggtgaagcaatagagctgttcaagaaattacgtgctatgaacgtgaagattaatgtcataacactcaataccatgatttctgctatgtttaaaactaggagaattgaagaagccaaggatttgtttgctactatatcagccatcggattggtgccttctgttgtgacttacagtgtaatgatgacgaatttcataaaagaagggttgctggcagaggctgatgatatgtttttagcaatggagaaggctggctgtgctcctgactccagactgctaaatcacgtggtcagagtgttgctggagaatggtgcagttgtaaaggctgtgacttatctcactaaacttgatgctaaacagctgtcacttgaagcttcaacggtttcgttcattgtatctctcttctcaaggaaagggaaattaagggagcatgtaaaattgcttccggtaaagtaccagcctcctgagatgttgggc

SEQ ID NO: 1669 - DNA, 2493 bp, Triticum aestivum
atgtccagcatccacctccgtcactgctccactatgcccatgtcccgcgtctgcctccgccgccgcctctcctcctcctcctccttctccaactgcacctcgccgccctccccaacctggtctccccacgccgcctttgccgcggccacagagcgcgtgcgagccggtacgctcagcccgcaagacgcacaccacctgttcgacgtattgtttcagcaggccattcgggtccccgagcgctcccttgatggattccttgccgccctcagccatgctacgtcctctgaagcctgcagagacggccccgccctcgccctcaccctcttcaaccgtgtctgccgagaagaagccggcatgcgggtggcgctgcccaccatcttcacctacggcatcctcatgaactgctgctgccgcgtacgtcgtccggacctagggcttgccttctttgggtgcatcctcagggcgggcctgaagacaaaccagatcgccgccaacaccgtcatcaagtgcctctgctgcgcaaaacatactgacgaggctgtcaatatgctgcttcataggatgtccgacctcggctgtgtgcctgatgccttctcatacaacaccattctgaagagcttgtgtgaagacggcaggagcttgcaggcgctcgacctactgctccagatggtgtcgaaggaaggaggtgcctgctctcccgacatggtggcatatagcacggtcatccacggcttcttgaaggaaggcaaagtagacaaggcatgcaatctattcaatgaaatgatgcggcaaggggttgtgcctgatgtggtgacgtatagctcgattatcgatgcattgtgcaaagccggagcaatgcacaaagcagagttgttccttcggcagatggttgataacggtgttcgaccggatgaggtgacatatactagcatgatccatggatattccactttgggccggctgaaagaggtgcgtaaaatgttcagagaaatgacaagctgtggtcttataccagatattgtcacttggaactcgttcatggactccctttgcaagcatggaagaaccaaagaagctgcaaaggttttcttctccatggctgcaaagggcaacaagcctaatattgtctcctacactattcttcttcatgggtatgccaatgaaggaagctttgctgatatgatgagtctcttcaattcaatgaaaggcggcggcattgtagccaactgcaaagttttcaacatattaattggtgcatatgctaaacgagggctgatagatgaagctatgctcatacttactgaaatgcggggacaaggactgagtccggatgtagtcacctattcaactctaatatctgcacattggagaatgggtaagctgactgatgcaatggataacttcagtcagatggttgttggtacgggagtacagccggacacagttttttatcactccctagttcagttcttatgtacacatggtgatttggtgaaagcgaaggagttgatttctgaaatgatgaataaaggtattgctcgtccaaacactgcactcttcagttcaataatggacagtctatgcaatgaaggaagggttatagatgcacaccatatctttgacttggttatagacataggtgagaaacctgatatcagtatgtttagtacgctgattgacggatattgcttagtcggcgagatggacaaagcatgtggagtacttgatgccatggtatcagctggcattgagcctaatgtcattacgtatagcacacttgtcagtagatattgtaaacgtggaaggatcgatgatgggttaattctgttcagacaaatgttgcataagaaagttaaacctacaactgttacatatgaaaccatactgaatggattatttcgtgctgggagaactgctgatgcaaagaaaatgttccatgagatgatcgaaagtggaataatggtgagcatttctgcatataatataattcttggaggactttgtagaaataattgcgcagatgaagcgatcgtcctattccagaaattacgtgcaatgaatgtgaagttcaatatcacaacactcaataccatcattaatgcattgtacaaggttgaaagaagagaagaagctaatgatttgtttgctgcattaccagccagcgggttggtgcctaatgcttccacttatggagttatggtacaaaatcttctaaaagaaggagcagtggaggaagctgacagtatgttttcatcaatggagaagagtggttgtgctcctagctctcgtcttataaatgatgtcatcagaactttattggaaaagggggagatagtcaaggccggaaaatatatgtctaaagttgatgggaagagcatctcacttcaagcttcaactagttcattgttgttgtctctcttttcagggaatgggaaatatcgggaacaactacaattgctccctgcaaagtaccaatttttcaatggaatcagt

SEQ ID NO: 1670 - DNA, 2493 bp, Triticum aestivum; identical to SEQ ID NO: 1669

SEQ ID NO: 1671 - DNA, 2493 bp, Triticum aestivum; identical to SEQ ID NO: 1669

SEQ ID NO: 1672 - DNA, 1713 bp, Triticum aestivum
atgatgcggcaaggggttgtgcctgatgtggtgacgtatagctcgattatcgatgcattgtgcaaagccggagcaatgcacaaagcagagttgttccttcggcagatggttgataacggtgttcggccggatgaggtgacatatactagcatgatccatggatattccactttgggccggctgaaagaggtgcgtaaaatgttcagagaaatgacaagctgtggtcttataccagatgttgtcacttggaactcgttcatggactccctttgcaagcatggaagaaccaaagaagctgcaaaggttttcttttccatggctgcaaagggcaacaagcctaatattgtctcctacactattcttcttcatgggtatgccaatgaaggaagctttgctgatatgatgagtctcttcaattcaatgaaaggcggcggcattgtagccaactgcaaagttttcaacatattaattggtgcatatgctaaacgagggctgatagatgaagctatgctcatacttactgaaatgcggggacaaggactgagtccggatgtagtcacctattcaactctaatatctgcacattggagaatgggtaagctgactgatgcaatggataagttcagtcagatggttgttggtatgggagtacagccggacacagttttttatcactccctagttcagttcttatgtacacatggtgatttggtgaaagcgaaggagttgatttctgaaatgatgaataaaggtattgctcgtccaaacactgcactcttcagttcaataatggacagtctatgcaatgaaggaagggttatagatgcacaccatatctttgacttggttatagacataggtgagaaacctgatatcagtatgtttagtacgctgattgacggatattgcttagtcggcgagatggacaaagcatgtggagtacttgatgccatggtatcagctggcattgagcctaatgtcattacgtatagcacacttgtcagtagatattgtaaacgtggaaggatcgatgatgggttaattctgttcagacaaatgttgcataagaaagttaaacctacaactgttacatatgaaaccatactgaatggattatttcgtgctgggagaactgctgatgcaaagaaaatgttccatgagatgatcgaaagtggaataatggtgagcatttctgcatataatataattcttggaggactttgtagaaataattgcgcagatgaagcgatcgtcctattccagaaattacgtgcaatgtatgtgaagttcaatatcacaacactcaataccatcattaatgcattgtacaaggttgaaagaagagaagaagctaatgatttgtttgctgcattaccagccagtgggttggtgcctaatgcttccacttacggagtaatggtacaaaatcttctaaaagaaggagcagtggaggaagctgacagtatgttttcatcaatggagaagagtggttgtgctcctagctctcgtcttataaatgatgtcatcagaactttattggaaaagggggagatagtcaaggccggaaaatatatgtctaaagttgatgggaagagcatctcacttgaagcttcaactagttcattgttgttgtctctcttttcagggaatgggaaatatcgggaacaactacaattgctccctgcaaagtaccaatttttcaatggaatcagt

SEQ ID NO: 1673 - DNA, 729 bp, Triticum aestivum
atgtccagcatccacctccgtcactgctccactatgcccatgtcccgcgtctgcctccgccgccgcctctcctcctcctccttctccaactgcacctcgccgccctccccaacctggtctccccacgccgcctttgccgcggccacagagcgcgtgcgagccggtacgctcagcccgcaagacgcacaccacctgttcgacgtattgtttcagcaggccattcgggtccccgagcgctcccttgatggattccttgccgccctcagccatgctacgtcctctgaagcctgcagagacggccccgccctcgccctcaccctcttcaaccgtgtctgccgagaagaagccggcatgcgggtggcgccgcacaccatcttcacctacggcatcctcatgaactgctgctgccgcgtacgtcgtccggacctagggcttgccttctttgggcgcatcctcagggcgggcctgaagacaaaccagatcgccgccaacaccgtcatcaagtgcctctgctgcgcaaaacatactgacgaggctgtcaatatgctgcttcataggatgtccgacctcggctgtgtgcctgatgccttctcatacaacaccgttctgaagagcttgtgtgaagacggcaggagcttgcaggcgctcgacctactgctccagatggttgctcccccgacgtggtggcttataacacggtcatctatggcttctttaaggaaggtgaag

SEQ ID NO: 1674 - DNA, 729 bp, Triticum aestivum; identical to SEQ ID NO: 1673

SEQ ID NO: 1675 - DNA, 1713 bp, Triticum aestivum; identical to SEQ ID NO: 1672

SEQ ID NO: 1676 - DNA, 1713 bp, Triticum aestivum; identical to SEQ ID NO: 1672

SEQ ID NO: 1677 - DNA, 729 bp, Triticum aestivum; identical to SEQ ID NO: 1673

SEQ ID NO: 1678 - DNA, 2274 bp, Triticum aestivum
atgccaaccgcccgcctgtcctccatcttcacctcctccttcaaggctccttcacgagagcgccgagctcccctcgccgccttggctgctgccacggagcgtgtgcgcgccggaacgctaagccaggaggacgcgcaccacctgttcgacgaattgctgagccaagccgccaccgtcccagtacgcgggctcaacaactttcttgctgcgctagctcgtgcaccgcccggactgctgtaccgaggcgctggtgcacgggtggtgtcgcccacgtgctgtacctattccatcctcatggactgctgctgccgtgcaggccgcccggacttggtgcttgccttcttcggccgcctcctcaggttggggctgcgctttgaggaggtcatccccttcaacaacctcctcaaggggctctgccaggccaagcgttcaaatgaggctttggacatgctgctccaccggatgcccgaactggactgtgcgcctgatgtcttctcgttcaacatagtaatcaacggctgctttaaagaaggtgaagtagacaaagcgtgcaatctcttccatgagatgccccaactgggagttcaacctgatgtggtgacctacacctcaatcatggacgcactaagcaagtccggagcaatggacaaggcagaagtgctccttcggcaaatggttgatcaaggaattgaacccaatatcaggacatatagctgtctgatccatggatattctacttttggtcagtggaaggaggcacttagggtattcaaagaaatggcaagtcttggtgttgtaccagacgttgtcacattgagctcattaatcgattccctttgcaggcacagaaggacaaagcaagctagagaaatttttgactctatggctgcaaagggcctgaaacctaatatcgtctcctactctactatgcttaatgggtatgtcaaagaaggatccttcgaggatatgaccggtctcttcaattcgatggtacggaatggtattgtacctaaccaccatattttcaacatactgatcaatgcatatgctaaacgtggactgatggatgaggctatgcacatgttcgaagtaatgaggcaacaaggagtaaacccagatgtatttggctatcaaatcataatggattcactttgtaaaatgggtaagatggatgctgctctggacaaatttaatcagatggtcaatcaaggagtttcacctaacaaagctgtttaccaatgcctggttctgggttcttgctctcatggtgattttgtgaaagccaaggaattgatttctgaagcggttaatagaggtctgtgttctaacagtgtgttcttctatcctgtaataaacgaccgttgcaaagaaggaaaggtgaaggacgcacaggatatgtttgacttcattgtaggtattggtcatcggcctgatgtgattatgtacaattcactgatggatggatattgccttgttggcaaggtggaggaagcactgagagtacttgatgctatgaagtctgctggcctccaacctgatgtttttacatatggtatacttattaatggctactgtaaaattggaaggatcgacgacggattgagtcttgtcagggaaatttcactcagtggggttaagcccacgactattatgtacaacattatacttgatgggctgttttgctctgggagaacagttcctgcaaaggaaaaattccataagatgaatgaaagtggcataccagtgggcgttggaacatacaacatagttcttagtggactttgtaaaaataattgcactgatgaagcaatagagctgttcaagaaattacgtgctgtgaacgtgaagattaatgtcataacactcactaccatggtttctgcaatgtttaaaactaggagaattgaagaagccaaggatttgtttgttactatatcagccattgggttggtgccttctgttgtgacttacagtataatgatgacaaatttcataaaagaagggttgcttgcagatgctgatgatatgttttcagcaatggagaaggctggctgtgctcacaactccagactgctaaatcaagtggtcagggtatttctgaagaatggtgaagttgtaaaggctgtgacttatcttgccaaatttgatgcaaaacagctgtcagttgaagcttcgacggtttcgttaatagtatctctcttctcaaggaaagggaaattaagggagcatgtaaaattgcttccggtaaagtaccagcctcctgagatgttggac

SEQ ID NO: 1679 - DNA, 2274 bp, Triticum aestivum; identical to SEQ ID NO: 1678

SEQ ID NO: 1680 - DNA, 1122 bp, Triticum aestivum
atgggtaagctgactgatgccatggataagttcagtcagatggttgttggtacgggagtacagccggacacagttgtttatcactccctagttcagttcttatgtacacatggtgatttggtgaaagcgaaggagttgatttctgaaatgatgaataaaagtattgctcgtccaaacactgcactctttagttcaataatggacagtctatgcaatgaaggaagggttatagatgcacaccatatctttgacttggttatagacataggtgagaaacctgatatcagtatgtttagtacgctgattgacggatattgcttagtcggcgagatggacaaagcatgtggagtacttgatgccatggtatcagctggcattgagcctaatgtcattacgtatagcacacttgtcagtagatattgtaaacgtggaaggatcgatgatgggttgattctgttcagacaaatgttgcataagaaagttaaacctacaactgttacatatgaaaccacactgaatggattatttcgtgctgggagaactgctgatgcgaagaaaatcttcgatgagatgatcgaaagtggaataatggcgagcatttctacatataatataattcttggaggactttgtagaaataattgcgcagatgaagcggtcgtcctattccagaaattacgtgcaatgaatgtgaagttcaatatcacaacactcaataccatcattaatgcattgtacaaggttgaaagaagagaagaagctaatgatttgtttgctgcattaccagtcagcgggttggtgcctaatgcttccacttacggagtgatggtacaaaatcttctaaaagaaggagcagtggaggaagctgacagtatgttctcatcaatggagaagagtggttgtgctcctagctctcgtcttgtaaatgatgtcatcagaactttattggaaaagggggagatagtcaaggccggaaaatatatgtctaaagttgatgggaagagcatctcacttgaagcttcaactagttcgttgttgttgtctctcttttcagggaatgggaaatatcgggaacaactacaattgctccctgcaaagtaccaatttttcgatggaatcagt

SEQ ID NO: 1681 - DNA, 2484 bp, Triticum aestivum
atgtccagcatccacctccgccattgctccactatgcccatgtcccgcgtctgcctccgccgccgcctctcctccttctccaactgcacctcgccgccctcaccaacctggtctccccacgccgcctttgccgcggccacggagcgcgtccgcgccggaacgctcagcccgcaagacgcacaccacctgttcgacgaattgtttcggcaggccactccggttcccgagcgctcccttgatggattccttgccgccctcggccgtgccacgccctctgaggcctgcagagacggcccctccctcgccctcaccctcttcaaccgtgtctgccgagaagaagccggcatgcgggttgcgccgccaaccatcttcacctacggcatcctcatgaactgctgctgccgtatgggtcgtccggacctagggctcgcctactttgggcgcatcctcagggcgggcctgaaggcaaaccagatcgccgccaacaccgtcatcaagtgcctctgctgcgcaaaacataccgacgaggctgtcaatatgctgcttcataggatgtccgacctcggctgtgtacctgatgccttctcatacaacacagttctgaagagcttgtgtgaagacggcaggagcttgcaggcgctcgacctactgctccagatggcgtcgaaggaaggaggtgcctgctcccccgacatggtggcatatagcacggtcatccacggcttcttgaaggaaggcaaagtagacaaggcatgcaatctattcgatgaaatgatgcggcaaggggttgtgcctgatgtggtgacgtatagctcgattatcgatgcattgtgcaaagctggagcaatgtacaaggcagagttgttccttcggcagatggttgatgatggtgttcgaccggatgaggtgacatatactagcatgatccatggatattccactttgggccggtggaaacaggtgcgtaaaatgttcagagaaatgacaagccgtggtcttataccagatactgtcacttggaactcgttcatggactccctctgcaagcatggaagaaccaaagaagctgcagaagttttcttttccatggctggaaagggcagcaagcctaatattgtctcctacactattcttcttcatgggtatgccaatgaaggaagctttgctgatatgatgagtctcttcaattcaatgaaaggcggcggcattgtagccaactgcaaagttttcaacatattaattggtgcatatgctaaacgagggctgatagatgaagctatgctcatacttactgaaatgcggggacaaggactgagtccggatgtagtcacctattcaactctaatatctgcacattggagaatgggtaagctgactgatgccatggataagttcagtcagatggttgttggtacgggagtacagccggacacagttgtttatcactccctagttcagttcttatgtacacatggtgatttggtgaaagcgaaggagttgatttctgaaatgatgaataaaagtattgctcgtccaaacactgcactcttcagttcaataatggacagtctatgcaatgaaggaagggttatagatgcacaccatatctttgacttggttatagacataggtgagaaacctgatatcagtatgtttagtacgctgattgacggatattgcttagtcggcgagatggacaaagcatgtggagtacttgatgccatggtatcagctggcattgagcctaatgtcattacgtatagcacacttgtcagtagatattgtaaacgtggaaggatcgatgatgggttgattctgttcagacaaatgttgcataagaaagttaaacctacaactgttacatatgaaaccatactgaatggattatttcgtgctgggagaactgctgatgcgaagaaaatcttcgatgagatgatcgaaagtggaataatggtgagcatttctacatataatataattcttggaggactttgtagaaataattgcgcagatgaagcggtcgtcctattccagaaattacgtgcaatgaatgtgaagttcaatatcacaacactcaataccatcattaatgcattgtacaaggttgaaagaagagaagaagctaatgatttgtttgctgcattaccagtcagcgggttggtgcctaatgcttccacttacggagtgatggtacaaaatcttctaaaagaaggagcagtggaggaagctgacagtatgttctcatcaatggagaagagtggttgtgctcctagctctcgtcttgtaaatgatgtcatcagaactttattggaaaagggggagatagtcaaggccggaaaatatatgtctaaagttgatgggaagagcatctcacttgaagcttcaactagttcgttgttgttgtctctcttttcagggaatgggaaatatcgggaacaactacaattgctccctgcaaagtaccaatttttcgatggaatcagt

SEQ ID NO: 1682 - DNA, 1122 bp, Triticum aestivum; identical to SEQ ID NO: 1680

SEQ ID NO: 1683 - DNA, 2484 bp, Triticum aestivum; identical to SEQ ID NO: 1681

SEQ ID NO: 1684 - DNA, 1011 bp, Triticum aestivum
atgcgggttgcgccgccaaccatcttcacctacggcatcctcatgaactgctgctgccgtatgggtcgtccggacctagggctcgcctactttgggcgcatcctcagggcgggcctgaaggcaaaccagatcgccgccaacaccgtcatcaagtgcctctgctgcgcaaaacataccgacgaggctgtcaatatgctgcttcataggatgtccgacctcggctgtgtacctgatgccttctcatacaacacagttctgaagagcttgtgtgaagacggcaggagcttgcaggcgctcgacctactgctccagatggcgtcgaaggaaggaggtgcctgctcccccgacatggtggcatatagcacggtcatccacggcttcttgaaggaaggcaaagtagacaaggcatgcaatctattcgatgaaatgatgcggcaaggggttgtgcctgatgtggtgacgtatagctcgattatcgatgcattgtgcaaagctggagcaatgtacaaggcagagttgttccttcggcagatggttgatgatggtgttcgaccggatgaggtgacatatactagcatgatccatggatattccactttgggccggtggaaacaggtgcgtaaaatgttcagagaaatgacaagccgtggtcttataccagatactgtcacttggaactcgttcatggactccctctgcaagcatggaagaaccaaagaagctgcagaagttttcttttccatggctggaaagggcagcaagcctaatattgtctcctacactattcttcttcatgggtatgccaatgaaggaagctttgctgatatgatgagtctcttcaattcaatgaaaggcggcggcattgtagccaactgcaaagttttcaacatattaattggtgcatatgctaaacgagggctgatagatgaagctatgctcatacttactgaaatgcggggacaaggactgagtccggatgtagtcacctattcaactctaatatctgcacat

SEQ ID NO: 1685 - DNA, 1011 bp, Triticum aestivum; identical to SEQ ID NO: 1684

SEQ ID NO: 1686 - DNA, 2484 bp, Triticum aestivum; identical to SEQ ID NO: 1681

SEQ ID NO: 1687 - DNA, 2484 bp, Triticum aestivum; identical to SEQ ID NO: 1681

SEQ ID NO: 1688 - DNA, 2439 bp, Triticum aestivum
atgtcccgcctccacctcctccgccgccgctgctccacctccatttccacctcgccgccttcacgctcctggtctccccgcgctgcctttgccgctgccacagagcgcgtccgcgccgggacgctcagcccggaagacgcacaccacctgttcgaccaattgctgcggcagtccaccccagtccccgagcgctccctgaatggattccttgccgccctcgtccgtacgccggcctcagaatcctgcagagacgggccctccctcgccctcgccctcttcaaccgtgtctgccgagaagaagccggcctgcgggtggcgccgcccaccatcttcacctacaacatcctcatgaactgctgttgcctggcgcgtcgcccggacctaggacttgcctttttcggccgcctcctcaggactggcctgaagacaaaccagagcttcgccaacaccctcctcaagtgcctctgctgcgcaaaacagacagacgaggctgtcagcgtgctgcttcataggatgtccgacctcggctgtgtgcctgatgacttctcatacaacacagttctaaagagcttgtgtgaagatagcaggagccggcgagcgctcgacctgctccagatgatggcgaaagaaggaggtgtctgctcccctgatgtggtcacatataacacagtcatccatggcttctttaaggaaggtgaaataggcaaggcctgcaatctattccatgaaatgatgcagcaaggggttgtgcctaatgtggtgacatataactcgattatcgatgcattgtgcaaggcccgagcaatggacaatgcagagttgttccttcgcatgatggttgataacggtgttccaccagataaggtgacatatactagcatgatccatggatattccactttgggccgatggaaagaggcaactaaaaagttcagagaaatgacaagcaggggtcttataccaggtattatcacttggaactcgttcatggactccctctgcaagcatggaagaagcaaagaagttgcagaaatttttcattccatgtctgcaaagggccacaagcctgatatcatctcctacaccactcttcttcatgggtatgccaatgaaggaagctttcctgatatgatgagtctctttaagtcaatggaaggcaacggtattgtagccaactgccaagttttcaacatattaattgatgcatatgctaaacgaggaatgatggacgaagctatgctcatatttaccgaaatgctaggacaaggagtcaatccgagtgtaatcacctactcaattgtgatagctgcactttgcagaatgggtaggctggccgatgctatggatacgttcagtcagatgatttctgttggaatgaaaccggacacagttgtttatcattccctaattcagggtttctctacacatggcgatttggtcaaagcgaaagaactgatatatgaaatgatgaacaacggtattcctcgtccaaacagtgtattcttcagttcaatagtaaacagtctatgcaaagaggggagggttgtggatgcacatcatatcttcgacttggttaaagacttaggtgagagacctaacatcattatgtttactacgctgattgacggatattgcttagtcggtgagatggacaaagcattcagagtacttgatgccatggtattagctggcgttgagcctgatgtcgttacatatagtacacttgtcaatggctattgtagtaatggaaggatcgatgatgggttgattctgttcagagaaatgttgcataagaaagttaaacctacaactgttacatataacatcatactggatcgattatttcgtgccgggagaacagttgctgcaaagaaaatgctccatgagatgatcggaagtggaacacctgtgagcatgcatacatacggcatatttcttagaggactttgtaggaacgattgcaccgatgaagcaattgccctgtttcaaaaattaggtgcactgaatgtgaacttcgatattacaatactcaattccatgattaatgcaatgtacagggttcagagaagagaagaagctaacaagttgtttgctgctatatcaaccagtgggttggtacctaatgcttccacttatggaatcatgatcagaaatcttctaaaagagggatcagtggaagaagctgaagacatgttttcatcaatggaggagagtgactgtgctctcagctctcgtcttataaatgatatcattagaacattattggaaaagggggatatagtcaaggccggaaaatacatgtctaaagttgatgaaacgagcatctcacttgaagcttcaactagttcgttgttgttgtctctcttttccgggaaagggaaatgtcgggaacaaatagaattgctccctgcaaagtaccaaattttcgatggaatcagt

SEQ ID NO: 1689 - DNA, 2439 bp, Triticum aestivum
atgtcccgcctccacctcctccgccgccgctgctccacctccatttccacctcgccgccttcacgctcctggtctccccgcgctgcctttgccgctgccacagagcgcgtccgcgccgggacgctcagcccggaagacgcacaccacctgttcgaccaattcctgcggcagtccaccccagtccccgagcgctccctgaatggattccttgccgccctcgtccgtacgccggcctcagaatcctgcagagacgggccctccctcgccctcgccctcttcaaccgtgtctgccgagaagaagccggcctgcgggtggcgccgcccaccatcttcacctacaacatcctcatgaactgctgttgcctggcgcgtcgcccggacctaggacttgcctttttcggccgcctcctcaggactggcctgaagacaaaccagagcttcgccaacaccctcctcaagtgcctctgctgcgcaaaacagacagacgaggctgtcagcgtgctgcttcataggatgtccgacctcggctgtgtgcctgatgacttctcatacaacacagttctaaagagcttgtgtgaagatagcaggagccggcgagcgctcgacctgctccagatgatggcgaaagaaggaggtgtctgctcccctgatgtggtcacatataacacagtcatccatggcttctttaaggaaggtgaaataggcaaggcctgcaatctattccatgaaatgatgcagcaaggggttgtgcctaatgtggtgacatataactcgattatcgatgcattgtgcaaggcccgagcaatggacaatgcagagttgttccttcgcatgatggttgataacggtgttccaccagataaggtgacatatactagcatgatccatggatattccactttgggcggatggaaagaggcaactaaaaagttcagagaaatgacaagcaggggtcttataccaggtattatcacttggaactcgttcatggactccctctgcaagcatggaagaagcaaagaagctgcagaaatttttcattccatgtctgcaaagggccacaagcctgatatcatctcctacaccactcttcttcatgggtatgccaatgaaggaagctttcctgatatgatgagtctctttaagtcaatggaaggcaacggtattgtagccaactgccaagttttcaacatattaattgatgcatatgctaaacgaggaatgatggacgaagctatgctcatatttaccgaaatgctaggacaaggagtcaatccgagtgtaatcacctactcaattgtgatagctgcactttgcagaatgggtaggctggccgatgctatggatacgttcagtcagatgatttctgttggaatgaaaccggacacagttgtttatcattccctaattcagggtttctctacacatggcgatttggtcaaagcgaaagaactgatatatgaaatgatgaacaacggtattcctcgtccaaacagtgtattcttcagttcaatagtaaacagtctatgcaaagaggggagggttgtggatgcacatcatatcttcgacttggttaaagacttaggtgagagacctaacatcattatgtttactacgctgattgacggatattgcttagtcggtgagatggacaaagcattcagagtacttgatgccatggtattagctggcgttgagcctgatgtcgttacatatagtacacttgtcaatggctattgtagtaatggaaggatcgatgatgggttgattctgttcagagaaatgttgcataagaaagttaaacctacaactgttacatataacatcatactggatcgattatttcgtgccgggagaacagttgctgcaaagaaaatgctccatgagatgatcggaagtggaacacctgtgagcatgcatacatacggcatatttcttagaggactttgtaggaatgattgcaccgatgaagcaattgccctgtttcaaaaattaggtgcactgaatgtgaacttcgatattacaatactcaattccatgattaatgcaatgtacagggttcagagaagagaagaagctaacaagttgtttgctgctatatcaaccagtgggttggtacctaatgcttccacttatggaatcatgatcagaaatcttctaaaagagggatcagtggaagaagctgaagacatgttttcatcaatggaggagagtgactgtgctctcagctctcgtcttataaatgatatcattagaacattattggaaaagggggatatagtcaaggccggaaaatacatgtctaaagttgatgaaacgagcatctcacttgaagcttcaactagttcgttgttgttgtctctcttttccgggaaagggaaatgtcgggaacaaatagaattgctccctgcaaagtaccaaattttcgatggaatcagt

SEQ ID NO: 1690 - DNA, 2439 bp, Triticum aestivum; identical to SEQ ID NO: 1688

SEQ ID NO: 1691 - DNA, 2439 bp, Triticum aestivum; identical to SEQ ID NO: 1689

SEQ ID NO: 1692 - DNA, 2439 bp, Triticum aestivum; identical to SEQ ID NO: 1688

SEQ ID NO: 1693 - DNA, 2439 bp, Triticum aestivum; identical to SEQ ID NO: 1689

SEQ ID NO: 1694 - DNA, 2109 bp, Triticum aestivum
atgccagccgcccgcctgtcctccttcaaggctccttcacgagagcgccgacctcccctcgccgccttggctgccgccacggagcgcgtccgcgccggaacgctaagtcggcaggacgcgcaccacctgttcgacgaattgctgagccaagccgcgacagtcccagtacgcaagctgaacaactttcttgccgccctcgcccgtgcaccgccctcagctgcctgcagcgatggtccggaccttgccatcgccctcttcaaccgcatgtcccgaggcgctggtgcacgggtggtgtcgcccacgctctctacctattccatcctcatggactgctgctgccgtgcacgccgcccagagttggtggttgccttcttcggccgcctcctcaggttggggctgcgcttggatatcatctcctccagcaatctcctcaaggggctctgccaggccaagcgttcaaatgaggctttggacatgctgctccaccggatgcccgaactggactgtgcgcctgatgtcttctcgttcaacatagtaatcaacggctgctttaaagaaggtgaagtagacaaagcgtgcaatctcttccatgagatgccccaactgggagttcaacctgatgtggtgacctacacctcaatcatggacgcactaagcaagtccggagcaatggacaaggcagaagtgctccttcggcaaatggttgatcaaggaattgaacccaatatcaagacatataactgtctgatccatggatattctacttttggtcagtggaaggcggcagttagagtattcaaagaaatggcaagtgttggtgttcaaccaaatgctgtcactttgaactcattaatcgattccctttgcaagcacagaaggacaaaggaagctagagaaattcttgactccatggccgcaaagggcctgaaacctaatatcgtctcctactctactatgcttaatgggtatgtcaaagaaggatgcttcgatgatatgactgatctcttcaattcgatggtacggaatggtatcgtacctaaccaccatattttcaacatactgatcaatgcatatgctaaacgtggagtgatggatgaggctatgcacatgttcgaagtaatgaggcaacaaggagtaaatccagatgtatttagctatcaaattgtaatggattcactttgcaaaatgggcaggatggatgctgctctggacaaatttaatcagatggtcaatcaaggagtttcacctaacaaagctgtttaccaatgcctggttctgggttcttgctctcatggtcattttgtgaaagccaaggaattgatttctgaagtggttaatagaggtctgtgttctaacagtgtgttcttctatcctgtaataaacggcctttgcaaagaaggaaaggtaaaggaggcacaggatatgtttgacttcatcctaggtattggtcagcggcctgatgtgattatgtacacttcactgatggatggatattgccttgttggcgaggtggagaaagcactgagtgtactcgatgctatgaaatctgctggccttcaacctgatgatgttgtatatgctacacttcttaacggttactgtaaaattggaaggatcgccgatggattgagccttttcagggaaatgtcactcagcggggttaagcccatgactattatatacaacattatactggatgggctgttttgctccgggagaacagtttgtgcaaaggaaaaattcaatacgatgactgaaagtggcataccagtgggcgttgacacatacaacatactccctctggaaagatttataagacgttttagaaagtgtagttcaaatctcggcacgttaagaaaattcggtcgtttccatttttgcccctgcgctcactcactcacccgcactcacccattcccctctcgcactcactcgcccgcgtcgacgtctccctgcccgaatccggcgcggtggcgacgctcctccctctcgcccgcgtcgacacctccccctcggccgcttcgcagcctcccttctcctcttgtcgccgcctctccctctcctcgcccgcgttgtctagccaaaattgttttcttagtgaggtcagga

SEQ ID NO: 1695 - DNA, 2109 bp, Triticum aestivum; identical to SEQ ID NO: 1694

SEQ ID NO: 1696 - DNA, 825 bp, Triticum aestivum
atgccgagaagaagccggcccgcaggtggcatcctcatgggctgcttctgcggtgcgcatcgcccggacctagggcttgccttatttggccgcttcctcgggacaggcctcaagacaaacaagattgtggccaccaccttcctcaagtgcctctgctacgccaaacgtacagatgaggctgtcaacttgctgcttcgtaggatgcccgagcttggctgcgtgcctgatgcaatctcatacaccattgttctgaagagcttatgcgagaatagcatgagtcagcgggcacttgacctgctccagatggtggcagaaggaggaggtgcctgctccctcaatgtggtggtgtatagcacagtcatccatggcttcttcaaggagggcgaaacaggcaaggcatgcaatctattccatgaaatgatccatcaaggggttgtgcccaatgtggtcacgtatagctcgattattgatgcgttgtgcaaggccagagcaatggacaaggcagagctagtccttcaacagatggttgatagtggtgctcaaccgaataatgtgacatataattgcatgatccatggatattccacatcagggcagttgaaagaggctgctaaaatgtttagaaaaatgacaagccatggtcttgtaccaaatgcagtcacttgcagctcgttaatgacttccctttgcaagcatggaagaagcaaagaagcggcggaaatattttattccatgactgccaagggccacaaaccggatgccgtctcgtaccgtattttgcttcatgggtatgccaatgaaggatgctttgctgatatgattgat

SEQ ID NO: 1697 - DNA, 825 bp, Triticum aestivum; identical to SEQ ID NO: 1696

SEQ ID NO: 1698 - DNA, 2421 bp, Triticum aestivum
atgccagccgcccgcctgtcctccatctccacctcctccttcaaggctccttcacgagagggccgagcccccctcgccgccttggctgctgccacggagcgcgtcctcgccggaacgctaagtcgccaggacgcgcaccatctgttcgacgaattgctgagccaagccgccgccgtcccggaacgcgggctcaacaactctcttgccgcactcgcccgtacaccgccctcagctgcctgcagcgatggccccggccttgccatcgccctcttcaaccgcatgtccagaggtgccggtgcactagtggcatcgtccacactctgtacctattccatcctcatggactgctgctgtcgcgcaggccgcccggacctggttgttgccttcttcggccgcctcctcaggttggggctgcgcttgaatgtcatctccttcaacaacctcctcaaggggctttgccaggctaagcgctcaaatgaggcattggatctgctgctccaccggatgcccgaactggactgtgcgcctgatgtcttctcgttcaacatagtaatcaacggctgctttagagaaggtgaagtagacaaagcatgcaatctcttccatgagatgccccaactgggagttcaacctgatgtggtgatctacaactcaattatcgacacactaagcaaatccggagcaatggacaaggcagaagtggtccttcgtcaaatggttgataaaggcattggacccgatgtcatgacatataacagtctgatccatggatattctactttgggtcagtggaaggcagcagttagggtattcaaagagatggtaagtgttggtgttctaccaaatgctgtcacgttgaactcatttatggattcactttgcaagcatagaagaacaaaggaagctagagatatttttgactccatggctgcaaagggccacaaacctaatattgcctcctactctactatgcttaatgggtatgcgaaacaaggatgcttcgacgatatgactggtctcttcaattccatggtacagaacggtattgtacctaacaaccatgttttcaacatactgatcagagcatattctacacgtggactgatggacaaggctatgcacatgttcgaagtaatgaagcaacaaggagtaaacccaaatgtagttgactatctagtaataatggattcactttgtaaaatgggtaggatggatgctgctctggacaaatttaatcagatggtcaatcaaggagtttcacctgacaaagttgtttaccgatgcctggttttaggttcttgctctcatggtcattttgtgaaagccaaggaattgatttctaaagcagttaatagaggtctatgttctaacagtgagttcttctatcctgtaataaacgacctgtgcaaagaaggaaaggtgaaggaggcacaggatatgtttgacttcattgtaggtattggtcagcggcctgatgtgattatgtacaattcactgatggatggatattgccttgttggcaaggtggaggaagcagtgagagtacttgatgctatgaagtctgctggcctccaacctactgctgttacgtatgctatacttcttaatggctactgtaaaattggaaggatcgccgctggattgagtcttttcatggaaatgtcactcagcggggttaagcccactactattatgtacaacattatacctgatgggctgttttgctctgggagaacagtttctgcaaaggagaaattcaatacgatgattgaaagtggcataccagtgggcgttgacacatacaacatagttcttcatggactttgtagaaacaattgcactgatgaagcaatagatttgttcaaaaaattatgtgcaagaaacgtgaagattgatgtcataacattcaataccgtgatttctgcaatgtttaaaactaggagaattgaagaagccaaggatttgtttgctactataccagccatcggattggtgccttctgttgtgacttacagtttaatgatgacgaatttcataaaagaagggtcgctggcagaggctgatgatatgtttttagcaatggagaaggatggctgtgctcctgactccagactgctaaatcaagtggtcagggtgttgctggaaaaaggtgcagttgtacaggctgcaacttatctggctaaacttgatgcaaaacaaatgtcacttgaagtgtcaacgatttcgttaattgtatatctcttctcaaggaaagggaaattaagggagcacgtaaaattgcttccgatgagtaccagcctccggagatgtcctactgatgttacttggtggtattcactcatagctgacagaatgtcattgcccccacctgccgtttttgaaaatgcagataattcatccattttgctgttgcctgatgtt

SEQ ID NO: 1699 - DNA, 1218 bp, Triticum aestivum
atggactgttgctgccgcgcgcgtcgcccggacctagggcttgccttattcggacgcttcctcaggacaggcctgaagacaaatgagatcatcgccaacaccttcctcaagtgcctctgctatgccaaacgtacaaatgaggctatcaacttgctgcttcataggatgcccgagcttggctgcgtgcctgatgccttctcatacaacattgttctgaagagcttatgcgagaatagcatgagtcagcgggcactcgacctgctccagatggtggcagaaggaggaggtgcctgctccctcaatgtggtggcgtatagcacagtcatccatggcttcttcaaggagggcgaaacaggcaaggcatgcaatctattccatgaaatgatccatcaaggggttgtgcccaatgtggtcacgtatagctctattattgatgcgttgtgcaaggccagagaaatggacaaggcagagctagtccttcaacagatggttgatagtggtgctcaaccgaataatgtgacatataattgcatgatccatggatattccacatcagggcagttgaaagaggctgctaaaatgtttagaaaaatgacaagccatggtcttgtaccaaatgcagtcacttgcagctcgttaatgacttccctttgcaagcatggaagaagcaaagaagcggcagaaatattttattccatgactgccaagggccacaaaccggatgccgtctcgtaccgtattttgcttcatgggtatgccactgagggatgctttgctgatatgattgatctcttcaattcaatggaaagcaatggttttgtagcagactgccatgttttcaccatattaattgatgcatatgctaaacgtggaatgatggatgaagctatgctcatatttaccgaaatgcaggaaaaaggagtgagtcccaatgtagtcacctattccactgtaatagccgcactttgcagattgggtaggctggccgatgctatggacaagttcaatgagatgattgatatgggtgttcagccgggcacaactgtttatcactccctaattcaggggttttgtatgcatgtagatttggttaaagccaaggagttagtttctgacatgataagcaaaggtattcctcgtcccaacattgtttttcttcaattcagttataaactatttgtgcaaagaaggacgggttatggatgcacaagatatctt

SEQ ID NO: 1700 - DNA, 894 bp, Triticum aestivum
atggatgcacaagatatctttgaattggttataagcatagatgggaagcctgatgtcattacatttaactcactgattgacggatattgcttagtcggcaagatggataaagcatttggagtacttgatgccatggtgtcagctggcattgagcctaatgttgttacatataatacacttgttaatggctattctagaaatggaaggatcgatgatggtttgactctgttcaggcaaatgccacgtaagagaataaaacctgacagtgctacatatggcatcatactggatgggttgtttcgtgctgggagaactgttgctgcaaggaaaatgttccatgagatgatcgaaagcggaataacagtgagcatttccacatacaatattatacttgcaggtctttctagaaacaattgtgcagaagaagcgatcgacttgtaccagaaattagttgcaatgaatgtgaagttcaatatttcaataatcaataccatgatcaatgcaatgtacaaggttaaaagaaaagaggaagctaaagatttgtttgctgctatatcagcgagtgggttggttcctaatgcttcgacttatggagtaatgataataaatattctaaaagatggagcagtggaagatgctaacaatatgttctcagcaatggacaggaatggtatagctccctgctctcgtcttataaatagtattatcagaattttgctggaaaaaggtgagatcaccatggccggactttatttgtcgaaacttgacgggaagaacatgttacttgaagcttcaactacttcactgatgttgtctctcttttcaaggaaagggaaatataaggaggatgtgaaatttctccctgcaaagtatcagttttttgatggatttggt

SEQ ID NO: 1701 - DNA, 2472 bp, Triticum aestivum
atgtcccgcctccgcctccgccgctcctccaccacgccgatgttccacctcctccgccgcagctcctcctctacctccatctcgcccccctcacgttcctggtctcccgaaggcgcctttgccgcggccacggcgcgcgtcagcgctggaacgctcagccctgaagaagcacaccacctgttcgacgaattgctgcggcagggcaccccggtccccagccgctccctgaacggcttccttgccacccttgcccgtgcgcccgcctccgcagcctacagcagagatggccctgccctcgccctcgctctcttcaaccgcgtgtgcacagaaaaagccggctcgcgggtggcgcatctcacagtccacacctacggcatcctcatggactgctgctgccgcgcgcgtcgcccggacctagggcttgccttattcggacgcttcctcaggacaggcctgaagacaaatgagatcatcgccaacaccttcctcaagtgcctctgctatgccaaacgtacaaatgaggctatcaacttgctgcttcataggatgcccgagcttggctgcgtgcctgatgccttctcatacaacattgttctgaagagcttatgcgagaatagcatgagtcagcgggcactcgacctgctccagatggtggcagaaggaggaggtgcctgctccctcaatgtggtggcgtatagcacagtcatccatggcttcttcaaggagggcgaaacaggcaaggcatgcaatctattccatgaaatgatccatcaaggggttgtgcccaatgtggtcacgtatagctctattattgatgcgttgtgcaaggccagagcaatggacaaggcagagctagtccttcaacagatggttgatagtggtgctcaaccgaataatgtgacatataattgcatgatccatggatattccacatcagggcagttgaaagaggctgctaaaatgtttagaaaaatgacaagccatggtcttgtaccaaatgcagtcacttgcagctcgttaatgacttccctttgcaagcatggaagaagcaaagaagcggcagaaatattttattccatgactgccaagggccacaaaccggatgccgtctcgtaccgtattttgcttcatgggtatgccactgagggatgctttgctgatatgattgatctcttcaattcaatggaaagcaatggttttgtagcagactgccatgttttcaccatattaattgatgcatatgctaaacgtggaatgatggatgaagctatgctcatatttaccgaaatgcaggaaaaaggagtgagtcccaatgtagtcacctattccactgtaatagccgcactttgcagattgggtaggctggccgatgctatggacaagttcaatgagatgattgatatgggtgttcagccgggcacaactgtttatcactccctaattcaggggttttgtatgcatgtagatttggttaaagccaaggagttagtttctgacatgataagcaaaggtattcctcgtcccaacattgtgttcttcaattcagttataaactatttgtgcaaagaaggacgggttatggatgcacaagatatctttgaattggttataagcatagatgggaagcctgatgtcattacatttaactcactgattgacggatattgcttagtcggcaagatggataaagcatttggagtacttgatgccatggtgtcagctggcattgagcctaatgttgttacatataatacacttgttaatggctattctagaaatggaaggatcgatgatggtttgactctgttcaggcaaatgccacgtaagagaataaaacctgacagtgctacatatggcatcatactggatgggttgtttcgtgctgggagaactgttgctgcaaggaaaatgttccatgagatgatcgaaagcggaataacagtgagcatttccacatacaatattatacttgcaggtctttctagaaacaattgtgcagaagaagcgatcgacttgtaccagaaattagttgcaatgaatgtgaagttcaatatttcaataatcaataccatgatcaatgcaatgtacaaggttaaaagaaaagaggaagctaaagatttgtttgctgctatatcagcgagtgggttggttcctaatgcttcgacttatggagtaatgataataaatattctaaaagatggagcagtggaagatgctaacaatatgttctcagcaatggacaggaatggtatagctccctgctctcgtcttataaatagtattatcagaattttgctggaaaaaggtgagatcaccatggccggactttatttgtcgaaacttgacgggaagaacatgttacttgaagcttcaactacttcactgatgttgtctctcttttcaaggaaagggaaatataaggaggatgtgaaatttctccctgcaaagtatcagttttttgatggatttggt

SEQ ID NO: 1702 - DNA, 894 bp, Triticum aestivum; identical to SEQ ID NO: 1700

SEQ ID NO: 1703 - DNA, 1218 bp, Triticum aestivum; identical to SEQ ID NO: 1699

SEQ ID NO: 1704 - DNA, 2472 bp, Triticum aestivum; identical to SEQ ID NO: 1701

SEQ ID NO: 1705 - DNA, 894 bp, Triticum aestivum; identical to SEQ ID NO: 1700

SEQ ID NO: 1706 - DNA, 894 bp, Triticum aestivum; identical to SEQ ID NO: 1700

SEQ ID NO: 1707 - DNA, 1218 bp, Triticum aestivum; identical to SEQ ID NO: 1699

SEQ ID NO: 1708 - DNA, 1218 bp, Triticum aestivum; identical to SEQ ID NO: 1699

SEQ ID NO: 1709 - DNA, 1605 bp, Triticum aestivum
atgatggtgttggaccttaatgtgacgtatagtagcctcatccatggatattcctcttcaggccactggaaggaggcagttagggtattcaaagagatgacaagtcggagggttacagcagatgtgcatacttacaacatgtttatgacctttctttgcaaacatggaagaagcaaagaagctgcaggaatttttgataccatggctatcaagggcctgaaacctgacaacgtttcatatgctattctccttcatgggtatgccgccgaaggatgcttagttgatatgattaatctcttcaattcaatggaaagagattgtattctacctgactgtcgtatcttcaacatactgattaatgcatatgctaaatctgggaagcttgataaggctatgcttatcttcaatgaaatgcagaaacaaggagtgagtccaaatgcagtcacatattcaaccgtaatacatgcattttgcaagaagggtaggttggatgatgctgtgataaagtttaatcagatgattgatacaggagtacgaccggacgcatctgtttatcgtcccctaatccagggtttttgtacacatggcgatttggtgaaagcaaaggaatatgttactgaaatgatgaagaaaggtatgcctcctcctgatattatgttcttcagttcaatcatgcagaacctatgcacagaaggaagggtaacagaagcacgggatatccttgacttgatagtgcacattggtatgaggcctaatgttatcatatttaatttgctgatcggtggatactgcctagtccgcaagatggcagatgcattgaaagtatttgatgatatggtgtcatatggtttagaaccttgtaactttacgtatggtatacttattaatggctattgcaaaaatagaaggattgatgacgggcttattctgttcaaagagatgctgcacaagggacttaaacctacaacttttaattataacgtcatactggatggattatttctggctggacaaactgttgctgcaaaagagaagtttgatgagatggttgaatctggagtaagtgtgtgcattgatacatactctataattcttggtggactttgtagaaatagctgcagtagcgaagcgatcacccttttccggaaattaagcgcaatgaatgtgaaatttgatattacaattgtcaatatcattattggtgccttatacagggtcgagagaaaccaagaggctaaggatttgtttgctgctatgccagccaatggcttggttcctaatgctgttacctacaccgtaatgatgacaaatcttataaaagaaggttcagtggaagaagctgacaatcttttcttatccatggagaagagcggctgtactgccaactcttgcctgttaaatcatatcatcagaaggttactggaaaaaggagagatagtcaaggctggaaattatatgtctaaagttgatgcaaagagctactcacttgaagctaaaactgtttcgctgctgatctctctgttttcaaggaaagggaaatatagagaacacatcaaattgcttcctacaaagtatcagtttctggaagaagcagccacagttgaa

SEQ ID NO: 1710 - DNA, 2364 bp, Triticum aestivum
atgccccgcttctcctccaccacgccaatgtcgccaccccgcctccgcctccgactctgcgcccgccactcctcctccacctctcatccctcacgcatctgggatccccacgccgccttcgccgccgcggcacagcgggcgagctctggcacgctcactacggaggacgcacaccacctgtttgacgaattgctgcggcggggcaatcctgtccaggagcgtcccttgaataaatttctggctgccctcgcccgcgcgcccgcgtccgcatcctgctgcgatggccccgccctggcagtcgccctcttcggccgtttgtcccgagacgtcggacgacgggtggcgcagccaaatgtcttcacctatggcgtcctcatggactgctgctgccgcgcttgccgcacagatctggtgctcgccttctttggccgtctcctcaagacgggcctggaggcaaaccaagtcgtcttcaacaccctcctcaagggcctttgccacacaaagcgggcggatgaggctctggacgtgctgcttcacaggatgcctgagctgggctgcactcctaatgtggtggcgtataacaccgttatccatggcttctttaaggaaggccatgtaagcaaggcctgcaatctgttccatgaaatggcgcagcagggcgttaagcctaatgtggtgacatataactcagttatcgatgcgctgtgcaaggccagagccatggacaaggcagaggtggtccttcgtcagatgattgatgatggtgttggacctgataatgtgacgtatagtagcctcatccatggatattcctcttcaggccactggaaggaggcagttagggtattcaaagagatgacaagtcggagggttacagcagatgtgcatacttacaacatgtttatgacctttctttgcaaacatggaagaagcaaagaagctgcaggaatttttgataccatggctatcaagggcctgaaacctgacaacgtttcatatgctattctccttcatgggtatgccgccgaaggatgcttagttgatatgattaatctcttcaattcaatggaaagagattgtattctacctgactgtcgtatcttcaacatactgattaatgcatatgctaaatctgggaagcttgataaggctatgcttatcttcaatgaaatgcagaaacaaggagtgagtccaaatgcagtcacatattcaaccgtaatacatgcattttgcaagaagggtaggttggatgatgctgtgataaagtttaatcagatgattgatacaggagtacgaccggacgcatctgtttatcgtcccctaatccagggtttttgtacacatggcgatttggtgaaagcaaaggaatatgttactgaaatgatgaagaaaggtatgcctcctcctgatattatgttcttcagttcaatcatgcagaacctatgcacagaaggaagggtaacagaagcacgggatatccttgacttgatagtgcacattggtatgaggcctaatgttatcatatttaatttgctgatcggtggatactgcctagtccgcaagatggcagatgcattgaaagtatttgatgatatggtgtcatatggtttagaaccttgtaactttacgtatggtatacttattaatggctattgcaaaaatagaaggattgatgacgggcttattctgttcaaagagatgctgcacaagggacttaaacctacaacttttaattataacgtcatactggatggattatttctggctggacaaactgttgctgcaaaagagaagtttgatgagatggttgaatctggagtaagtgtgtgcattgatacatactctataattcttggtggactttgtagaaatagctgcagtagcgaagcgatcacccttttccggaaattaagcgcaatgaatgtgaaatttgatattacaattgtcaatatcattattggtgccttatacagggtcgagagaaaccaagaggctaaggatttgtttgctgctatgccagccaatggcttggttcctaatgctgttacctacaccgtaatgatgacaaatcttataaaagaaggttcagtggaagaagctgacaatcttttcttatccatggagaagagcggctgtactgccaactcttgcctgttaaatcatatcatcagaaggttactggaaaaaggagagatagtcaaggctggaaattatatgtctaaagttgatgcaaagagctactcacttgaagctaaaactgtttcgctgctgatctctctgttttcaaggaaagggaaatatagagaacacatcaaattgcttcctacaaagtatcagtttctggaagaagcagccacagttgaa

SEQ ID NO: 1711 - DNA, 774 bp, Triticum aestivum
atgccccgcttctcctccaccacgccaatgtcgccaccccgcctccgcctccgactctgcgcccgccactcctcctgcacctctcatccctcacgcatctgggatccccacgccgccttcgccgccgcggcacagcgggcgagctctggcacgctcactacggaggacgcacaccacctgtttgacgaattgctgcggcggggcaatcctgtccaggagcgtcccttgaataaatttctggctgccctcgcccgcgcgcccgcgtccgcatcctgctgcgatggccccgccctggcagtcgccctcttcggccgtttgtcccaagacgtcagacgacgggtggcgcagccaaatgtcttcacctatggcgtcctcatggactgctgctgccgcgcttgccgcacagatctggcgctcgccttctttggccgtctcctcaagacgggcctggaggcaaaccaagtcgtcttcaacaccctcctcaagggcctttgccacacaaagcgggcggatgaggctctggacgtgctgcttcacaggatgcctgagctgggctgcactcctgatgtggtggcgtataacaccgttatccatggcttctttaaggaaggccatgtaagcaaggcctgcaatctgttccatgaaatggcgcagcagggcgttaagcctaatgtggtgacatataactcagttatcgatgcgctgtgcaaggccagagccatggacaaggcagaggtggtccttcgtcagatgattgatgatggtgttggacct

SEQ ID NO: 1712 - DNA, 2364 bp, Triticum aestivum; identical to SEQ ID NO: 1710

SEQ ID NO: 1713 - DNA, 1626 bp, Triticum aestivum
atgccgaccggccggctgtcctccatcttcaccagcaatgcaacctcctccttcagggctccttcgccacagccacgagcccccctcgccgccttggctgccgccacggagcgcgtccgcgccggaacgctaagtcggcaggacgcgcaccacctgttcgacgaattgctgagccaagccgcgacagtcccagtacgcacgctcaacaattttcttgccgccctcgcccgtgctccgccctcagctgcctgtggcgatggccctgcccttgccatcgccctcttcaaccgcatgtcccaaggcgctggtgcacgggtggtgtcgcccacgctctgtacctattccatcctcatggactgctgctgccgcgcaggccgcccggacttggtggttgccttcttcggccgcctcatcaggttggggctgcgcttgaatgtcatccccttcaacaacctcctcaaggggctttgcaaggccaagcgctcaaatgaggcattggatctgctgctccaccggatgcccgaactggactgtgcgcctgatgtcttctcgtacagcatagtaatcaacggctgttttaaagaaggtgaagtagacaaagcgtgcaatctcttccatgggatgatccaactgggagttcaacctaatgtggtcatctacacctcaattatcgatgcactaagcaagtgcggagccatggacaaggcagaagtggtctttcggcaaatggttgataaaggtattggacccgatgtcatgacatgcactagtctgatccatggatattccatttcgggtaggtggaaggcggcagtaagggtattcaaagagatgataagtcttggtgttgtaccagataccgtcatgtggaactcatttgtggattcactttgcaagcatagaaggacaaaggaagctagagttatttttgactccatggctgcaaagggccagaaacctgatactgtctcctactctattatgcttaacgggtatgtgaaagaaggatgctttgatgatatgaccggtctcttcaattcgatgctacagaacggtgttgtacctaaccaccatattttcaacatactgatcaatgcatatgctaaacgtggactgatggatgaggctatgcacatgttcgaagtaatgaggcaacaaggagtaaacccagatgtagttgactatctagtagtaatggattcactttgcaaaatgggtaggatggatgctgctctggacaaatttaatcagatggtcaatcaaggagtttcacctaacaaagctgtttaccaatgcctggttctgggttcttgctctcatggtgattttgtgaaagccaaggaattgatttctgaagcacttaatagaggtctctgttctaacagtgtgttcttctatcctgtaataaacgacctgtgcaaagaaggaaaggtgaaggaggcacaggatatgtttgacttcattgtaggtattggtcagcggcccgatgtgattatgtacaattcactgatggatggatattgccttgttggcaaggtggaggaagcactgagagtacttgatgctatgaagtctgctggcctccaacctgatgctattatgtatggtatacttcttaatgatcac

SEQ ID NO: 1714 - DNA, 2328 bp, Triticum aestivum
atgccgaccggccggctgtcctccatcttcaccagcaatgcaacctcctccttcagggctccttcgccacagccacgagcccccctcgccgccttggctgccgccacggagcgcgtccgcgccggaacgctaagtcggcaggacgcgcaccacctgttcgacgaattgctgagccaagccgcgacagtcccagtacgcacgctcaacaattttcttgccgccctcgcccgtgctccgccctcagctgcctgtggcgatggccctgcccttgccatcgccctcttcaaccgcatgtcccaaggcgctggtgcacgggtggtgtcgcccacgctctgtacctattccatcctcatggactgctgctgccgcgcaggccgcccggacttggtggttgccttcttcggccgcctcatcaggttggggctgcgcttgaatgtcatccccttcaacaacctcctcaaggggctttgcaaggccaagcgctcaaatgaggcattggatctgctgctccaccggatgcccgaactggactgtgcgcctgatgtcttctcgtacagcatagtaatcaacggctgttttaaagaaggtgaagtagacaaagcgtgcaatctcttccatgggatgatccaactgggagttcaacctaatgtggtcatctacacctcaattatcgatgcactaagcaagtgcggagccatggacaaggcagaagtggtctttcggcaaatggttgataaaggtattggacccgatgtcatgacatgcactagtctgatccatggatattccatttcgggtaggtggaaggcggcagtaagggtattcaaagagatgataagtcttggtgttgtaccagataccgtcatgtggaactcatttgtggattcactttgcaagcatagaaggacaaaggaagctagagttatttttgactccatggctgcaaagggccagaaacctgatactgtctcctactctattatgcttaacgggtatgtgaaagaaggatgctttgatgatatgaccggtctcttcaattcgatgctacagaacggtgttgtacctaaccaccatattttcaacatactgatcaatgcatatgctaaacgtggactgatggatgaggctatgcacatgttcgaagtaatgaggcaacaaggagtaaacccagatgtagttgactatctagtagtaatggattcactttgcaaaatgggtaggatggatgctgctctggacaaatttaatcagatggtcaatcaaggagtttcacctaacaaagctgtttaccaatgcctggttctgggtttttgctctcatggcgattttgtgaaagccaaggaattgatctctgaaacaattaatagaggtctgtgttctaacaatgtgttcttctatcctgtaataaacgacctgtgcaaagaaggaaaggtgaaggaggcacaggatatgtttgacttcattgtaggtattggtcagcggcccgatgtgattatgtacaattcactgatggatggatattgccttgttggcaaggtggaggaagcactgagagtacttgatgctatgaagtctgctggcctccaacctgatgctattacgtatgctatacttcttaatggctactgtaaaattggcaggatcgccgatggattgagtcttttcagggaaatgtcactcagcggggttaagcccacgactattatgtacagcattatacttgatgggctgtttcgctccgggagaacagtttctgcaaaggaaaaattcaatacgatggttgaaagtggcttaccagtggacgttcgcacatacaacatagttcttcatggactttgtagaaacaattgcactggtgaagcaatagagttgttcaaaaaattatgtgcaacgaacgtgaagattaatgtcataacattcaataccatgatttctgcaatgtttaaaactaggagaattggagaagccaaggatttgtttgctactatatcagccatcgggttggtgccttctgttgtgacttacagtgtaatgacgacgaatttcataaaagaagggttgctggcggaggctgatgatatgtttttagcaatggagaaggctggctgtgctcccaactccaggctgctaaatcacgtggtcagagtgttgctggagaatggtgcagttgtaaaggctgcaacttatctcgctaaacttgatgcaaaacagctttcacttgaagcttcgacagtttcgttaattgtatctctcttctcaaggaaagggaaattaagggagcatgtaaagttgcttccggtaaagtaccagcctcctgagatgttggac

SEQ ID NO: 1715 - DNA, 2007 bp, Triticum aestivum
  misc_feature (82)..(82): n is a, c, g, or t
atgcatcaaggcgttggatgcactgacccgagcggacggggacaaaatccacgcccgtcggcaacctctcacccctccctcnccgttcacagtctagattcgtcagccgcctcccaggccgctcgccggcggccaggaccaccggagttcctgagtctcctttctctccgacggaggcacgcctcctcttcatcgccactgttgagggcatcggttgcaaccccgcggcggcggcgagcggttcccccgagtgcttggttagtgccgagcatcgcgggtgacgccactagagcgcggtgcggcggcgcacgcacggtcagccttcccggagggcaagacccgcggcagttgcgcgccgagctccgctggagacggccagcaatgccgaccggccggctgtcctccatcttcaccagcaatgcaacctcctccttcagggctccttcgccacagccacgagcccccctcgccgccttggctgccgccacggagcgcgtccgcgccggaacgctaagtcggcaggacgcgcaccacctgttcgacgaattgctgagccaagccgcgacagtcccagtacgcacgctcaacaattttcttgccgccctcgcccgtgctccgccctcagctgcctgtggcgatggccctgcccttgccatcgccctcttcaaccgcatgtcccaaggcgctggtgcacgggtggtgtcgcccacgctctgtacctattccatcctcatggactgctgctgccgcgcaggccgcccggacttggtggttgccttcttcggccgcctcatcaggttggggctgcgcttgaatgtcatccccttcaacaacctcctcaaggggctttgcaaggccaagcgctcaaatgaggcattggatctgctgctccaccggatgcccgaactggactgtgcgcctgatgtcttctcgtacagcatagtaatcaacggctgttttaaagaaggtgaagtagacaaagcgtgcaatctcttccatgggatgatccaactgggagttcaacctaatgtggtcatctacacctcaattatcgatgcactaagcaagtgcggagccatggacaaggcagaagtggtctttcggcaaatggttgataaaggtattggacccgatgtcatgacatgcactagtctgatccatggatattccatttcgggtaggtggaaggcggcagtaagggtattcaaagagatgataagtcttggtgttgtaccagataccgtcatgtggaactcatttgtggattcactttgcaagcatagaaggacaaaggaagctagagttatttttgactccatggctgcaaagggccagaaacctgatactgtctcctactctattatgcttaacgggtatgtgaaagaaggatgctttgatgatatgaccggtctcttcaattcgatgctacagaacggtgttgtacctaaccaccatattttcaacatactgatcaatgcatatgctaaacgtggactgatggatgaggctatgcacatgttcgaagtaatgaggcaacaaggagtaaacccagatgtagttgactatctagtagtaatggattcactttgcaaaatgggtaggatggatgctgctctggacaaatttaatcagatggtcaatcaaggagtttcacctaacaaagctgtttaccaatgcctggttctgggttcttgctctcatggtgattttgtgaaagccaaggaattgatttctgaagcacttaatagaggtctctgttctaacagtgtgttcttctatcctgtaataaacgacctgtgcaaagaaggaaaggtgaaggaggcacaggatatgtttgacttcattgtaggtattggtcagcggcccgatgtgattatgtacaattcactgatggatggatattgccttgttggcaaggtggaggaagcactgagagtacttgatgctatgaagtctgctggcctccaacctgatgctattatgtatggtatacttcttaatgatcac

SEQ ID NO: 1716 - DNA, 2217 bp, Triticum aestivum
atgccctctgaggcctgcagagacggccccttcctcgccctcaccctcttcaaccgtgtctgccgagaagaagccggcatgcgggttgcgccgccaaccatcttcacctacggcatcctcatgaactgctgctgccgtatgggtcgtccggacctagggctcgcctactttgggcgcatcctcagggcgggcctgaaggcaaaccagatcgccgccaacaccgtcatcaagtgcctctgctgcgcaaaacatagtgacgaggctgtcaatatgctgcttcataggatgtccgacctcggctgtgtgcctgatgccttctcatacaacaccgttctgaagagcttgtgtgaagatggcaggagcttgcaggcgctcgacctactgctccagatggcgtcgaaggaaggaggtgcctgctcccccgacatggtggcatatagcacggtcatccacggcttcttgaaggaaggcaaagtagacaaggcatgcaatctgttcgatgaaatgatgcggcaaggggttgtgcctgatgtggtgacgtatagctcgattatcgatgcattgtgcaaagctggagcaatgtacaaggcagagttgttcctttggcagatggttgatgatggtgttcgaccggatgaggtgacatatactagcatgatccatggatattccactttgggccggtggaaacaggtgcgtaaaatgttcagagaaatgacaagccgtggtcttataccagatactgtcacttggaactcgttcatggactccctctgcaagcatggaagaaccaaagaagctgcagaagttttcttttccatggctggaaagggcagcaagcctaatattgtctcctacactattcttcttcatgggtatgccaatgaaggaagctttgctgatatgatgagtctcttcaattcaatgaaaggcggcggcattgtagccaactgcaaagttttcaacatattaattggtgcatatgctaaacgagggctgatagatgaagctatgcttatacttactgaaatgcggggacaaggactgagtccggatgtagtcacctattcaactctaatatctgcacattggagaatgggtaagctgactgatgccatggataagttcagtcagatggttgttggtacgggagtacagccggacacagttgtttatcactccctagttcagttcttatgtacacatggtgatttggtgaaagcgaaggagttgatttctgaaatgatgaataaaagtattgctcgtccaaacactgcactcttcagttcaataatggacagtctatgcaatgaaggaagggttatagatgcacaccatatctttgacttggttatagacataggtgagaaacctgatatcagtatgtttagtacgctgattgacggatattgcttagtcggcgagatggacaaagcatgtggagtacttgatgccatggtatcagctggcattgagcctaatgtcattacgtatagcacacttgtcagtagatattgtaaacgtggaaggatcgatgatgggttgattctgttcagacaaatgttgcataagaaagttaaacctacaactgttacatatgaaaccacactgaatggattatttcgtgctgggagaactgctgatgcgaagaaaatcttcgatgagatgatcgaaagtggaataatggtgagcatttctacatataatataattcttggaggactttgtagaaataattgcgcagatgaagcgatcatcctattccagaaattacgtgcaatgaatgtgaagttcaatatcacaacactcaataccatcattgatgcattgtacaaggttgaaagaagagaagaagctaatgatttatttgctgcattaccagccagcgggttggtgcctaatgcttccacttacggagtaatggtacaaaatcttctaaaagaaggagcagtggaggaagctgacagtatgttctcatcaatggagaagagtggttgtgctcctagctctcgtcttgtaaatgatgtcatcagaactttattggaaaagggggagatagtcaaggccggaaaatatatgtctaaagttgatgagaagagcatctcacttgaagcttcaactagttcgttgttgttgtctctcttttcagggaatgggaaatatcgggaacaactacaattgctccctgcaaagtaccaatttttcgatggaatcagt

SEQ ID NO: 1717 - DNA, 2475 bp, Triticum aestivum
atgtcccgcctccgcctccgccactgctcctgcttcaccacgcccatgtcccgcatccgcctccgccgccgcctctcctcttccacctcacgacccacaccctcccggtctccccgcgccgcctttgcggcggccacggagcgtgtccgcgccggaacgctcagcccgcaagacgcacaccacctgttcgacgaattgtttcagcaggccaccccggtccccgagcgccccctcaacggattccttgccgccctcacccgtgccacgccctccgaagcctgcagagacggccccgctctcgccctctccctcttcaaccgtgtctgccgagaagaagccggcatgcgggtggcgccgcccaccatcttcacgtacggcgtcctcatgaactgctgctgccgcatgcgtcgtccggaacttgggctcgccttcttcggccgcctcctaaggacgggcctgaaggcagacaagatcgtcgccaacactgtcctcaagtgcctgtgctgcgctaaacgggcagacgacgctgtgaaagtgctgcttcataggatgaccgagctggggtgtgtgcctgatgccttctcatacgccattgtcctgaagagcttatgtgatgataacaggagccaacaggcgctctacctgctccggatgatggcgaaagaagaaggtgtgtgctcccctgacgtggtcacatataacaccgtcatccatggcttctttaaggaaggaaaaataggcaaggcctgcaatctattccatgaaatgacgaagcaagggtttgtgcctaatgtggtgacatataactcggttatcaatgcattgtgcaaggcccgagcaatggacaatgcagagttgttccttcggcagatggttgataacggcgttcaaccgaataaagtgacatatactagcatgatccatggatattccactttgggccagtggaaagaggcgactaaactgttcagagaaatgacaagcagtggtcttataccagatattgtcacttggaactcgttcattgactccctttgcaagcatggaagaagcaaagaagctgcagaaatttttcattccatgtctgcaaagggccacaagcctgatatcatctcctacaccactcttcttcatgggtatgccaatgaaggaagctttcctgatatgatgagtctctttaagtcaatggaaggcgacggtattgtagccaactgccaatttttcaacatattaattgatgcatatgctaaacgaggaatgatggacgaagctatgctcatatttactgaaatgccaggacaaggagtcaatccaaatgtagtcacctattcaactgtggtagcttcactttgcagaatgggtaggctggctgatgcaatgaataagttcagtgagatgattggtacgggagtacaaccgaacacagttgtttatcactccctagttcagggcttatgtacacatggtgatttggtgaaagcgaaggagttgatttctgaaatgatgaataaaggtattcctcgtccaaacattgcattcttcagttcaatagtacacagtctatgcaaagaaggaagggttatggatgcacaccatatctttgacttggttaaagacataggggagagatctgacatcattatgtttaatacgctgattgatggatattgcctagttggtgagatgggcaaagcagtcagtgtactagatgtcatgatatcagccggcattgagcctgatatctttacatataatacacttgtcaatggttattttaagagtggaaggatcgatgatgggttgaatctgttcagagaaatgtcacataagaaaattaaacctacaactgttacatataacatcatactggatggattatttcgtgctgggagaaccgttgctgccaagaaaatgctccatgagttgatcggatgtggaacaacagtgagcttgtccacatacaacataattcttaaaggactttgtagaaataattgcaccgacgaagcaatcgtcatgttccagaaattacacacaattaatgtaaagttcaatatcacaacactcaataccatgattaattcaatgtacactgttcagagaagagaagaagctaaaaatttgtttgctgcaatatcagacagcgggttggtgcccaatgcctctacatacggcataatgatacgaaatcttctaaaagaaggatcagtggaagaagctgacagtatgttcttatcaatggagaggagtggttgtgctccttgctctcgtcttttaaatgatactattagaacgttattggagaagggggagatagtcaaggccggaaattatatgtctaaagttgatggcaagagcatctcacttgaagcttcaacttgttcattgttgttgtctctgttttctgggaaaggtaaatatcgtgaacaaatacaattgctccctgtaaaataccaattcttcggtggagttagt

SEQ ID NO: 1718 - DNA, 2475 bp, Triticum aestivum
atgtcccgcccccgcctccgccactgctcctgcttcaccacgcccatgtcccgcatccgcttccgccgccgcctctcctcttccacctcacgacccacaccctcctggtctccccgcgccgcctttgcggcggccacggagcgcgtccgcgacggaacgctcagcccgcaagacgcacaccacctgttcgacgaattgtttcagcaggccaccccggtccccgaccgccccctcaacggattccttgccgccctcacccgtgccacgccctccgaggcctgcagagacggccctgctctcgccctctccctcttcaaccgtgtctaccgagaagaagccggcatgcgggtggcgccgccgaccatcttcacctacggcgtcctcatgaactgctgctgccgcatgcgtcgtccggaacttgggctcgccttcttcggccgcctcctaaggacgggcctgaaggaagacaagatcgtcgccaacactgtcctcaagtgcctgtgctgcgctaaacgggcagacgacgctgtgaaagtgctgcttcatacgatgaccgagctggggtgtgtgcctgatgccttctcatacgccattgtcctgaagagcttatgtgatgataacaggagccagcaggcgctctacctgctccggatgatggcgaaagaagaaggtgtgtgctcccctgacgtggtcacatataacaccgtcattcatggcttctttaaggaaggaaaaataggcaaggcctgcaatctattccatgaaatgacgaagcaagggtttgtgcctaatgtggtgacatataactcggttatcaatgcattgtgcaaggcccgagcaatggacaatgcagagttgttccttcggcagatggttgataacggcgttcaaccgaataaagtgacatatactagcatgatccatggatattccactttgggccagtggaaagaggcgactaaactgttcagagaaatgacaagcagtggtcttataccagatattgtcacttggaactcgttcattgactccctttgcaagcatggaaggagcaaagaagctgcagaaatttttcattccatgtctgcaaagggccacaagcctgatatcatctcctacaccactcttcttcatgggtatgccaatgaaggaagctttcctgatatgatgagtctctttaagtcaatggaaggcgacggtactgtagccaactgccaatttttcaacatattaattgatgcatatgctaaacgaggaatgatggacgaagctatgctcatatttactgaaatgccaggacaaggagtcaatccaaatgtagtcacctattcaactgtgatagcttcactttgcagaatgggtaggctggctgatgcaatgaataagttcagtgagatgattggtacgggagtacaaccgaacacagttgtttatcactccctagttcagggcttatgtacacatggtgatttggtgaaagcgaaggagttgatttctgaaatgatgaataaaggtattcctcgtccaaacattgcattcttcagttcaatagtacacagtctatgcaaagaaggaagggttatggatgcacaccatatctttgacttggttaaagacataggggagagatctgacatcattatgtttaatacgctgattgatggatattgcctagtcggtgagatgggcaaagcagtcagtgtactagatgtcatgatatcagccggcattgagcctgatatctttacatataatacacttgtcaatggttattttaagagtggaaggatcgatgatgggttgaatctgttcagagaaatgtcacataagaaaattaaacctacaactgttacatataacatcatactggatggattatttcgtgctgggagaaccgttgctgccaagaaaatgctccatgagttgatcggatgtggaacaacagtgagcttgtccacatacaacataattcttaaaggactttgtagaaataattgcaccgacgaagcaatcgtcatgttccagaaattacacacaattaatgtaaagttcaatatcacaacactcaataccatgattaattcaatgtacactgttcagagaagagaagaagctaaagatttgtttgctgcaatatcagacagcgggttggtgcccaatgcctctacatacggcataatgatacgaaatcttctaaaagaaggatcagtggaagaagctgacagtatgttcttatcaatggagaggagtggttgtgctccttgctctcgtcttttaaatgatactattagaacgttattggagaagggggagatagtcaaggccggaaattatatgtctaaagttgatggcaagagcatctcacttgaagcttcaacttgttcattgttgttgtctctgttttctgggaaaggtaaatatcgtgaacaaatacaattgctccctgtaaaataccaattcttcggtggagttagt

SEQ ID NO: 1719 - DNA, 2475 bp, Triticum aestivum; identical to SEQ ID NO: 1718

SEQ ID NO: 1720 - DNA, 2475 bp, Triticum aestivum; identical to SEQ ID NO: 1718

SEQ ID NO: 1721 - DNA, 2475 bp, Triticum aestivum; identical to SEQ ID NO: 1718

SEQ ID NO: 1722 - DNA, 2475 bp, Triticum aestivum; identical to SEQ ID NO: 1718

SEQ ID NO: 1723 - DNA, 2475 bp, Triticum aestivum; identical to SEQ ID NO: 1718

SEQ ID NO: 1724 - DNA, 2091 bp, Triticum aestivum
atgaactgctgccgccgcacgcgtcgtccggaacttgggctcgccttctttgggcgcgtcctcaggatgggcctgaggacaaacgtggtcgtcgccaccacggtcctccagtgcctctgcggcgccaaacggacagatgaggccgtggacatcctgctacatcggatgtccgagctcgggtgcgtgcctgatgccttctcatactccattgttctgaagagcttatgcgatgatggcaggagccagcgggcactcgacctgctccacatgtgggagaaagaacgaggtctctgctcccccaacgtagtgatgtataacacggtcatccacggcttctttaaggaaggtgaagtaagcaaggcatgcattctattccatgaaatggagcagaaaggggttgtgcctaatgtggtgacatatagcttgaccattgacgcgctgtgcaaggccagagctatggacaaagcacagttgttcctccggcagatgattgataaaggtgttcgaccgaacaatgtgacatataatgtcatgatccatggatattgcactctgggacagtggaaggaagcgcgtaaaatgttcagagaaatgacaagacagggtctcataccagatattgttacttggacctcgttcatggcctctctctgtaagcatggaagaaccaaagaagctgccgaattctttgattccatgactgccaagggccacaagcctgatttggtcatgtatcatgttctgctccatgggtatgcaaccaaaggatgctttgctgatatgattaatctctttaattcaatggcaaccaagggtattgtacccgatcgtcaggttttcaacattttaattgatgcacatgctaaacatggaatgatggatgaagctatgcacatatttactggaatgcagggacaaggagtgtgtccagatgtatggacctattcaactctaatatctgcactttgcagaatgggtaggctggctgatgccatggataacttcagtcagatgattggtaagggagtacaaccgaacacagttgtttatcactccctaattcagggtttctctacacatggtgatttgaggaaagcaaaggagttggtttatgaaatgacaaacaaaggtattccttgtccaaacattgcattcttcagttctgtaatggacagtatatgcaaagaaggaagggttatggatgcacatgatatcttccacttggttacagacataggtctgaaacctaacatcattacgtttaatacgctgattgatggacattgcttagccggtgagatggagaaagcatttggagtacttgattccatggtatcagctggcatcgaggctgatgtttttacatataatacacttgcttatggctattgtagatgtggaaggattgatgatgggttgattctattcagagaaatgttgcaaaacaaacctaaacccacaacaatcacatataacatcatactggatgggttatttcgtgctgggagaacatttgctgcaaagaaaatgttcgttgagatgattgaaacgggaataacagtgagcatttccacatacagtataatacttggaggactttgtaggaataattgctctgacgaagcgatcaccctatttcagaaattaggaacaatgaatgtgaagtttgatattaaaatactcaataccatgatcaatgccatgttcaaggttcggagaagagaagaaactaacggtttgtttgctgcaatatcagccagtgggatggtacctaatgcttctacctacagcgtaatgataggaaatcttctaaaagaaggatcagtggaagaagctgaaaatatgttctcattaatggagaagagtggttgtgctccagactctcgtcttataaataatatcatcagaatattgttggaaaacggtgacatcgtcaaggctggaaattatatgtctaaagttgatggcaagagcatctcacttgaagcttcaactacttcgttgttgatgtgtctcttttcaagtaaagggaaatatcgggaacaaatcagtttgctccctgtaaattaccaatttttcaatggagtcggt

SEQ ID NO: 1725 - DNA, 2472 bp, Triticum aestivum
atgtcccgcctccgccactccacctccaccgcgccgatgccccacctccgccttctccgctgccgctcctcctccatctccaccttgccgccgtcacgctcatggtctcccgtcaccgcctttgccgcggccacagagcgcgtcagcgctgggacgctcagtccggaagacgcacaccgcctgttcgacgaattgcttcggcaggccactccggtccccgcgcgctccctgaacggcttcctcacggccctctcccgtgcgccgggcaccggcgcctgcggagacggccccgccctcgccctcgccctcttcaaccgcacccgccgagaagaggccggctcccgggtggtgccgtccacaatcttcacctacggcatcctcatgaactgctgccgccgcacgcgtcgtccggaacttgggctcgccttctttgggcgcgtcctcaggatgggcctgaggacaaacgtggtcgtcgccaccacggtcctccagtgcctctgcggcgccaaacggacagatgaggccgtggacatcctgctacatcggatgtccgagctcgggtgcgtgcctgatgccttctcatactccattgttctgaagagcttatgcgatgatggcaggagccagcgggcactcgacctgctccacatgtgggagaaagaacgaggtctctgctcccccaacgtagtgatgtataacacggtcatccacgacttctttaaggaaggtgaagtaagcaaggcatgcagtctattccatgaaatggagcagaaaggggttgtgcctaatgtggtgacatatagcttgaccattgacgcgctgtgcaaggccagagctatggacaaagcacagttgttcctccggcagatgattgataaaggtgttcgaccgaacaatgtgacatataatgtcatgatccatggatattgcactctgggacagtggaaggaagcacgtaaaatgttcagagaaatgacaagacagggtctcataccagatattgttacttggacctcgttcatggcctctctttgtaagcatggaagaaccaaagaagctgccgaattctttgattccatgactgccaagggccacaagcctgatttggtcatgtatcatgttctgctccatgggtatgcaaccaaaggatgctttgctgatatgattaatctctttaattcaatggcaaccaagggtattgtacccgatcgtcaggttttcaacattttaattgatgcacatgctaaacatggaatgatggatgaagctatgcacatatttactggaatgcagggacaaggagtgtgtccagatgtatggacctattcaactctaatatctgcactttgcagaatgggtaggctggctgatgccatggataacttcagtcagatgattggtaagggagtacaaccgaacacagttgtttatcactccctaattcagggtttctctacacatggtgatttgaggaaagcaaaggagttggtttatgaaatgacaaacaaaggtattccttgtccaaacattgcattcttcagttctgtaatggacggtatatgcaaagaaggaagggttatggatgcacatgatatcttccacttggttacagacataggtctgaaacctaacatcattacgtttaatacgctgattgatggacattgcttagtcggtgagatggagaaagcatttggagtacttgattccatggtatcagctggcattgaggctgatgtttttacatataatacacttgcttatggctattgtagatgtggaaggattgatgatgggttgattctattcagagaaatgttgcaaaacaaacctaaacccacaacaatcacatataacatcatactggatgggttatttcgtgctgggagaacatttgctgcaaagaaaatgttcgttgagatgatcgaaacgggaataacagtgagcatttccacatacagtataatacttggaggactttgtaggaataattgctctgacgaagcgatcaccctatttcagaaattaggagcaatgaatgtgaagtttgatattaaaatactcaataccatgatcaatgccatgttcaaggttcggagaagagaagaagctaacggtttgtttgctgcaatatcagccagtgggatggtacctaatacttctacctacagcgtaatgataggaaatcttctaaaagaaggatcagtggaagaagctgaaaatatgttctcattaatggagaagagtggttgtgctccagactctcgtcttataaataatatcatcagaatattgttggaaaacggtgacatcgtcaaggctggaaattatatgtctaaagttgatggcaagagcatctcacttgaagcttcaactacttcgttgttgatgtgtctcttttcaagtaaagggaaatatcgggaacaaatcagtttgctccctgtaaattaccaatttttcaatggagtcggt

SEQ ID NO: 1726 - DNA, 2472 bp, Triticum aestivum
atgtcccgcctccgccactccacctccaccgcgccgatgccccacctccgccttctccgctgccgctcctcctccatctccaccttgccgccgtcacgctcatggtctcccgtcaccgcctttgccgcggccacagagcgcgtcagcgctgggacgctcagtccggaagacgcacaccgcctgttcgacgaattgcttcggcaggccactccggtccccgcgcgctccctgaacggcttcctcacggccctctcccgtgcgccgggcaccggcgcctgcggagacggccccgccctcgccctcgccctcttcaaccgcacccgccgagaagaggccggctcccgggtggtgccgtccacaatcttcacctacggcatcctcatgaactgctgccgccgcacgcgtcgtccggaacttgggctcgccttctttgggcgcgtcctcaggatgggcctgaggacaaacgtggtcgtcgccaccacggtcctccagtgcctctgcggcgccaaacggacagatgaggccgtggacatcctgctacatcggatgtccgagctcgggtgcgtgcctgatgccttctcatactccattgttctgaagagcttatgcgatgatggcaggagccagcgggcactcgacctgctccacatgtgggagaaagaacgaggtctctgctcccccaacgtagtgatgtataacacggtcatccatgacttctttaaggaaggtgaagtaagcaaggcatgcagtctattccatgaaatggagcagaaaggggttgtgcctaatgtggtgacatatagcttgaccattgacgcgctgtgcaaggccagagctatggacaaagcacagttgttcctccggcagatgattgataaaggtgttcgaccgaacaatgtgacatataatgtcatgatccatggatattgcactctgggacagtggaaggaagcgcgtaaaatgttcagagaaatgacaagacagggtctcataccagatattgttacttggacctcgttcatggcctctctttgtaagcatggaagaaccaaagaagctgccgaattctttgattccatgactgccaagggccacaagcctgatttggtcatgtatcatgttctgctccatgggtatgcaaccaaaggatgctttgctgatatgattaatctctttaattcaatggcaaccaagggtattgtacccgatcgtcaggttttcaacattttaattgatgcacatgctaaacatggaatgatggatgaagctatgcacatatttactggaatgcagggacaaggagtgtgtccagatgtatggacctattcaactctaatatctgcactttgcagaatgggtaggctggctgatgccatggataacttcagtcagatgattggtaagggagtacaaccgaacacagttgtttatcactccctaattcagggtttctctacacatggtgatttgaggaaagcaaaggagttggtttatgaaatgacaaacaaaggtattccttgtccaaacattgcattcttcagttctgtaatggacggtatatgcaaagaaggaagggttatggatgcacatgatatcttccacttggttacagacataggtctgaaacctaacatcattacgtttaatacgctgattgatggacattgcttagtcggtgagatggagaaagcatttggagtacttgattccatggtatcagctggcattgaggctgatgtttttacatataatacacttgcttatggctattgtagatgtggaaggattgatgatgggttgattctattcagagaaatgttgcaaaacaaacctaaacccacaacaatcacatataacatcatactggatgggttatttcgtgctgggagaacatttgctgcaaagaaaatgttcgttgagatgatcgaaacgggaataacagtgagcatttccacatacagtataatacttggaggactttgtaggaataattgctctgacgaagcgatcaccctatttcagaaattaggagcaatgaatgtgaagtttgatattaaaatactcaataccatgatcaatgccatgttcaaggttcggagaagagaagaagctaacggtttgtttgctgcaatatcagccagtgggatggtacctaatacttctacctacagcgtaatgataggaaatcttctaaaagaaggatcagtggaagaagctgaaaatatgttctcattaatggagaagagtggttgtgctccagactctcgtcttataaataatatcatcagaatattgttggaaaacggtgacatcgtcaaggctggaaattatatgtctaaagttgatggcaagagcatctcacttgaagcttcaactacttcgttgttgatgtgtctcttttcaagtaaagggaaatatcgggaacaaatcagtttgctccctgtaaattaccaatttttcaatggagtcggt

SEQ ID NO: 1727 - DNA, 2472 bp, Triticum aestivum; identical to SEQ ID NO: 1726

SEQ ID NO: 1728 - DNA, 2508 bp, Triticum aestivum
atgtcccgcctccgccactccacctccaccgcgccgatgtcccgcctccgccactccacctccaccgcgccgatgccccacctccgccttctccgctgccgctcctcctccatctccaccttgccgccgtcacgctcatggtctcccgtcaccgcctttgccgcggccacagagcgcgtcagcgctgggacgctcagtccggaagacgcacaccgcctgttcgacgaattgcttcggcaggccactccggtccccgcgcgctccctgaacggcttcctcacggccctctcccgtgcgccgggcaccggcgcctgcggagacggccccgccctcgccctcgccctcttcaaccgcacccgccgagaagaggccggctcccgggtggtgccgtccacaatcttcacctacggcatcctcatgaactgctgccgccgcacgcgtcgtccggaacttgggctcgccttctttgggcgcgtcctcaggatgggcctgaggacaaacgtggtcgtcgccaccacggtcctccagtgcctctgcggcgccaaacggacagatgaggccgtggacatcctgctacatcggatgtccgagctcgggtgcgtgcctgatgccttctcatactccattgttctgaagagcttatgcgatgatggcaggagccagcgggcactcgacctgctccacatgtgggagaaagaacgaggtctctgctcccccaacgtagtgatgtataacacggtcatccacgacttctttaaggaaggtgaagtaagcaaggcatgcagtctattccatgaaatggagcagaaaggggttgtgcctaatgtggtgacatatagcttgaccattgacgcgctgtgcaaggccagagctatggacaaagcacagttgttcctccggcagatgattgataaaggtgttcgaccgaacaatgtgacatataatgtcatgatccatggatattgcactctgggacagtggaaggaagcacgtaaaatgttcagagaaatgacaagacagggtctcataccagatattgttacttggacctcgttcatggcctctctttgtaagcatggaagaaccaaagaagctgccgaattctttgattccatgactgccaagggccacaagcctgatttggtcatgtatcatgttctgctccatgggtatgcaaccaaaggatgctttgctgatatgattaatctctttaattcaatggcaaccaagggtattgtacccgatcgtcaggttttcaacattttaattgatgcacatgctaaacatggaatgatggatgaagctatgcacatatttactggaatgcagggacaaggagtgtgtccagatgtatggacctattcaactctaatatctgcactttgcagaatgggtaggctggctgatgccatggataacttcagtcagatgattggtaagggagtacaaccgaacacagttgtttatcactccctaattcagggtttctctacacatggtgatttgaggaaagcaaaggagttggtttatgaaatgacaaacaaaggtattccttgtccaaacattgcattcttcagttctgtaatggacggtatatgcaaagaaggaagggttatggatgcacatgatatcttccacttggttacagacataggtctgaaacctaacatcattacgtttaatacgctgattgatggacattgcttagtcggtgagatggagaaagcatttggagtacttgattccatggtatcagctggcattgaggctgatgtttttacatataatacacttgcttatggctattgtagatgtggaaggattgatgatgggttgattctattcagagaaatgttgcaaaacaaacctaaacccacaacaatcacatataacatcatactggatgggttatttcgtgctgggagaacatttgctgcaaagaaaatgttcgttgagatgatcgaaacgggaataacagtgagcatttccacatacagtataatacttggaggactttgtaggaataattgctctgacgaagcgatcaccctatttcagaaattaggagcaatgaatgtgaagtttgatattaaaatactcaataccatgatcaatgccatgttcaaggttcggagaagagaagaagctaacggtttgtttgctgcaatatcagccagtgggatggtacctaatacttctacctacagcgtaatgataggaaatcttctaaaagaaggatcagtggaagaagctgaaaatatgttctcattaatggagaagagtggttgtgctccagactctcgtcttataaataatatcatcagaatattgttggaaaacggtgacatcgtcaaggctggaaattatatgtctaaagttgatggcaagagcatctcacttgaagcttcaactacttcgttgttgatgtgtctcttttcaagtaaagggaaatatcgggaacaaatcagtttgctccctgtaaattaccaatttttcaatggagtcggt

SEQ ID NO: 1729 - DNA, 2472 bp, Triticum aestivum; identical to SEQ ID NO: 1725

SEQ ID NO: 1730 - DNA, 2508 bp, Triticum aestivum
atgtcccgcctccgccactccacctccaccgcgccgatgtcccgcctccgccactccacctccaccgcgccgatgccccacctccgccttctccgctgccgctcctcctccatctccaccttgccgccgtcacgctcatggtctcccgtcaccgcctttgccgcggccacagagcgcgtcagcgctgggacgctcagtccggaagacgcacaccgcctgttcgacgaattgcttcggcaggccactccggtccccgcgcgctccctgaacggcttcctcacggccctctcccgtgcgccgggcaccggcgcctgcggagacggccccgccctcgccctcgccctcttcaaccgcacccgccgagaagaggccggctcccgggtggtgccgtccacaatcttcacctacggcatcctcatgaactgctgccgccgcacgcgtcgtccggaacttgggctcgccttctttgggcgcgtcctcaggatgggcctgaggacaaacgtggtcgtcgccaccacggtcctccagtgcctctgcggcgccaaacggacagatgaggccgtggacatcctgctacatcggatgtccgagctcgggtgcgtgcctgatgccttctcatactccattgttctgaagagcttatgcgatgatggcaggagccagcgggcactcgacctgctccacatgtgggagaaagaacgaggtctctgctcccccaacgtagtgatgtataacacggtcatccacgacttctttaaggaaggtgaagtaagcaaggcatgcagtctattccatgaaatggagcagaaaggggttgtgcctaatgtggtgacatatagcttgaccattgacgcgctgtgcaaggccagagctatggacaaagcacagttgttcctccggcagatgattgataaaggtgttcgaccgaacaatgtgacatataatgtcatgatccatggatattgcactctgggacagtggaaggaagcacgtaaaatgttcagagaaatgacaagacagggtctcataccagatattgttacttggacctcgttcatggcctctctttgtaagcatggaagaaccaaagaagctgccgaattctttgattccatgactgccaagggccacaagcctgatttggtcatgtatcatgttctgctccatgggtatgcaaccaaaggatgctttgctgatatgattaatctctttaattcaatggcaaccaagggtattgtacccgatcgtcaggttttcaacattttaattgatgcacatgctaaacatggaatgatggatgaagctatgcacatatttactggaatgcagggacaaggagtgtgtccagatgtatggacctattcaactctaatatctgcactttgcagaatgggtaggctggctgatgccatggataacttcagtcagatgattggtaagggagtacaaccgaacacagttgtttatcactccctaattcagggtttctctacacatggtgatttgaggaaagcaaaggagttggtttatgaaatgacaaacaaaggtattccttgtccaaacattgcattcttcagttctgtaatggacggtatatgcaaagaaggaagggttatggatgcacatgatatcttccacttggttacagacataggtctgaaacctaacatcattacgtttaatacgctgattgatggacattgcttagtcggtgagatggagaaagcatttggagtacttgattccatggtatcagctggcattgaggctgatgtttttacatataatacacttgcttatggctattgtagatgtggaaggattgatgatgggttgattctattcagagaaatgttgcaaaacaaacctaaacccacaacaatcacatataacatcatactggatgggttatttcgtgctgggagaacatttgctgcaaagaaaatgttcgttgagatgatcgaaacgggaataacagtgagcatttccacatacagtataatacttggaggactttgtaggaataattgctctgacgaagcgatcaccctatttcagaaattaggagcaatgaatgtgaagtttgatattaaaatactcaataccatgatcaatgccatgttcaaggttcggagaagagaagaagctaacggtttgtttgctgcaatatcagccagtgggatggtacctaatgcttctacctacagcgtaatgataggaaatcttctaaaagaaggatcagtggaagaagctgaaaatatgttctcattaatggagaagagtggttgtgctccagactctcgtcttataaataatatcatcagaatattattggaaaacggtgacattgtcaaggctggaaattatatgtctaaagttgatggcaagagcatctcacttgaagcttcaactacttcgttgttgatgtgtctcttttcaagtaaagggaaataccgggaacaaatcagtttgctccctgtaaattaccaatttttcaatggagtcagt

SEQ ID NO: 1731 - DNA, 2364 bp, Triticum aestivum
atgcctggcttctcctccaccgcgtcaatgtcgccactgcgcctccgcctgcacgcccgccactcctcctccgcctcgcaaccctcacgcagccagggatgggatccccacgccgccttcgccgccgccacgcagcgtgcgcgctctggcagcctcaccccggcggacgcacaccacctgttcgacgaattgctgcggcaggcaaatcctgtccaggagcgccccctcaacaaccttctcgccgccatcgcccgcgcgccggcgtccagcgcctgcagagacggccctgcactcgcggttgccctcttcagtcgcatatcccaaggcgcccgccgacgtgtggcacatccaacggcttgcacctacggcatcctcatggactgctgctgccgtgcacgccgccctgatctgtcactcgccttattcggtcgtctcctcaggacgggcctgaaggcagaccaagtcgttttcagcaccctcctcaagggactctgccacgcaaagcgctcagatgaggctctgcatgtgctgctgcacaggatgcctgagctcggctgcacccccgacgtggtggtgtttaacaccgtcatccatggattcttcagggaaggccaagtaggcaaggcgtgcgatatgttccttggaatggcgcagcagggcgttgcgcctaatgtggtgacatataactcggttattgatgcactgtgcaaggccagggccatggacaaggcggagtatttccttcgtcaaatggttgataatggtgtcgtacctgataatgtgacttataatagcctcatccatggatactcctcttcaggccatcaaaaggaggtgcttagggtgctgaaagaaatgacaagtcagggtattataccagatgttgttacttgcaactcgctcatggcctacctttgcaagaacggaagaagcaaagaagctgcagaattttttgactccatggtcatgaagggcctgaaacctaatatcgtctcgtacagtactctgcttcacgggtatgccaccgaagggtgcttagttgatatgattaatctctttaattcaatgacaagagatggtattcaacctgactgtcatgttttgaacatactgattaatgcatatgctaaatctggcatgatggatgaggctatccttatgttcaaagaaatgcagaagcgaggagtgagtccagatgtagtcacctattcaaccgtaatacatggattttgcaaaatgggtaggttggacgatgctatggtaaaatttaagcagatgactgatatgggagtacgaccgaatccaattgtttaccattccctaatcaagggtttttgtacacatggggatttagtgaaagcaaaggaattggttactgaaatgaggaacaaagctatgcgtcctcctgatattaagttcttccattcaataatgcagaacctatgcacggaaggaagggtaatagaagcacgggatatcctcgacttgatggtgcacataggtatgaggcctgatgttttgatatttaatgtactgattggtggatactgcctagtctgcaagatggaggatgcctcgaaaatatttgatgatatggtatcatatggtttagaaccttgtaatattacgtatggtatacttattaatggctattgcaaaaacagaaggattgatgaggggctgattctattcaaagaaatgttgtgcaagggacttaaacctacaacttttaactataacgtcatactggatggattatttctggctggacgaactgttgctgcaaaggagaagtttaatgagatggttgaatctggagtaagtgtgtgcattgatacatgctctatagttcttggtggactttgtaaaaatagctgcagcagcgaagcgatcaccctgttccggaaattaagcacaatgaatgtgaaattagatattaaaattgtcaatatcattattggtgcattctacagggtcaagagaaaccaagaggctaaggatttgtttgctgctataacagccaatggcttggttcctaatgctgttacctacagcataatgatgacaaatcttataaaagaaggttcagtggaagaagccgacaatctttttttatcaatggagaagagcggctctactgcaaactcttggatgttaaataatattatcagaaggttactggaaagaagagagatagtcaaggctggaaattatatgtctaaagttgatgtaaagagctactcacttgaagctaaaactgtttcactgctgatctctctgttttcaagggaagggaaatatagagaccacatcaaattgctccctacaaagtatcagtttctgaaagaaccagccacagttgaa

SEQ ID NO: 1732 - DNA, 2145 bp, Triticum aestivum
atgcctggcttctcctccaccgcgtcaatgtcgccactgcgcctccgcctgcacgcccgccactcctcctccgcctcgcaaccctcacgcagccagggatgggatccccacgccgccttcgccgccgccacgcagcgtgcgcgctctggcagcctcaccccggcggacgcacaccacctgttcgacgaattgctgcggcaggcaaatcctgtccaggagcgccccctcaacaaccttctcgccgccatcgcccgcgcgccggcgtccagcgcctgcagagacggccctgcactcgcggttgccctcttcagtcgcatatcccaaggcgcccgccgacgtgtggcacatccaacggcttgcacctacggcatcctcatggactgctgctgccgtgcacgccgccctgatctgtcactcgccttattcggtcgtctcctcaggacgggcctgaaggcagaccaagtcgttttcagcaccctcctcaagggactctgccacgcaaagcgctcagatgaggctctgcatgtgctgctgcacaggatgcctgagctcggctgcacccccgacgtggtggtgtttaacaccgtcatccatggattctttagggaaggccaagtaggcaaggcgtgcgatatgttccttggaatggcgcagcagggcgttgcgcctaatgtggtgacatataactcggttattgatgcactgtgcaaggccagggccatggacaaggcggagtatttccttcgtcaaatggttgataatggtgtcgtacctgataatgtgacttataatagcctcatccatggatactcctcttcaggccatcaaaaggaggtgcttagggtgctgaaagaaatgacaagtcagggtattataccagatgttgttacttgcaactcgctcatggcctacctttgcaagaacggaagaagcaaagaagctgcagaattttttgactccatggtcatgaagggcctgaaacctaatatcgtctcgtacagtactctgcttcacgggtatgccaccgaagggtgcttagttgatatgattaatctctttaattcaatgacaagagatggtattcaacctgactgtcatgttttgaacatactgattaatgcatatgctaaatctggcatgatggatgaggctatccttatgtttaaagaaatgcagaagcgaggagtgagtccagatgtagtcacctattcaaccgtaatacatggattttgcaaaatgggtaggttggacgatgctatggtaaaatttaagcagatgactgatatgggagtacgaccgaatccaattgtttaccattccctaatcaagggtttttgtacacatggggatttagtgaaagcaaaggaattggttactgaaatgaggaacaaagctatgcgtcctcctgatattaagttcttccattcaataatgcagaacctatgcacggaaggaagggtaatagaagcacgggatatcctcgacttgatggtgcacataggtatgaggcctgatgttttgatatttaatgtactgattggtggatactgcctagtctgcaagatggaggatgcctcgaaaatatttgatgatatggtatcatatggtttagaaccttgtaatattacgtatggtatacttattaatggctattgcaaaaacagaaggattgatgaggggctgattctattcaaagaaatgttgtgcaagggacttaaacctacaacttttaactataacgtcatactggatggattatttctggctggacgaactgttgctgcaaaggagaagtttaatgagatggttgaatctggagtaagtgtgtgcattgatacatgctctatagttcttggtggactttgtaaaaatagctgcagcagcgaagcgatcaccctgttccggaaattaagcacaatgaatgtgaaattagatattaaaattgtcaatatcattattggtgcattctacagggtcaagagaaaccaagaggctaaggatttgtttgctgctataacagccaatggcttggttcctaatgctgttacctacagcataatgcccggtttaaaactgagtagtatacttaaaccgtcaatcgtaaaccggctttcattttgtctttcacagtttgtctttccaaga

SEQ ID NO: 1733 - DNA, 2439 bp, Triticum aestivum
atgtcccgcgtccgcctccacctccaccgccggctcctctcctccacctcaccgccctcacgttcctggtctccccgcgacgcctttgctgcggccgcagagcgcgtgcgtgctggtacactcagtcgagacgatgcacaccacctgttcgacaaattgtttcggcaggccaccccggtccccaaccgctccctgaacggcttccttgcctctctcgcgcgtgctacgtccaccactgcctgcatcaaagatggccccgccctcgcccttgctctcttcaaccgtgtgtgcagagaagaagccggcccgcaggtggccgcgcccaccgtttgcacctacaacatcctcatggactgctgctgccgcgctcgtcgcccagacctagggcttgccttattcgggtgtatcctcaggacgggcttgaagatagagcaaatcaccgccaacaccctcctcaagtgcctctgctatgcaaaacggacgggtgaggctgtgaacgtgctgcttcataggatgtccgagctcggatgtgtgcctgatgtctttgcatacaccacagttcttaagagcttatgtgaaggtagcaagagcctgcaggcgctcgacctgctccggacgatggcaaaagatagaggtggctgcttccctgatgtggtggcatataatacggtcatccatggctttttcaaggagggcgaaacaggcaaggcatgcaatctattccatgaaatgatccatcaaggggttgagcccgatgtggtgacgtacaacttggtcattgatgcgttgtgcaaggctagagcaatggacaaggcagaagtagtccttcagcagatggtcgataaaggtgttcaacctgatacagtgacatatacttacatgatccatggatattccatatctggacggtggaaagagactgctaaattgttcagagaaatgacaagccggggtcttataccaaatattgttacttgcaactcattcctgacctccctttgcaagcatggaagaagcaaagaagctgcagaatttttcgattccatgactgccaagggccacaaaccgaatatcgtctcataccgtattttgcttcatgggtatgctactaaaggatgcttccctgatatgattgatgtctttaattcaatggaaagcaatggtattgcagccgactgccatgttttcaacatattaattgatgcatatgctaaacgtgggatgatggatgaagctatgctgataccaagtaaaatgcaggaacgcagagtgaatcctgatatagtcacctattccagcataatagctggactttccagattgggtaggctgactgaggccatggaaaaattcaatcagatgattgccttgggagtacaaccggacaaagctgtttatcacacgctgattcagggtttttgcatagatggtgatttggctaaagctaagcagttggtttctgaaatgatgaacagaggtattcctcgtcctaacattgtgttcttcaattcagtaataaacagtatgtgcaaggaaggaagggttatggatgcacatgatatctttgagttggttatagacatgggtgagaggcctgataacattttatttaattcactgattgacggatactgcttagtcgggaagatggataaagcattaaaagtacttgatgtcatggaatcagttggtgttgagcctgatgttattacatataatacacttgttaatggctattgtagaaatggaaggatcgttgatggtttgactctgttcagagagatgccgcgtaaaagaattaaacctgacactatttcatatcgcatcataatggatgggttgtttcgttctgggagaactgtttctgcaaggcaaatgttccatgagatgatcgaaagtggaacaacagtcagcatttccacttacaatgtaatacttggaggtctttgtagaaataattgtgcagacgaagcgattgccctgttccagaaattaggttcaatgaatgtgaagttcagtattgcaatcgtcaataccatgattaatgcaatgtataaggttcaaagaaaagaagaagctaaggatttgtttgctgcaatatcagcaagtgggctggtgcataatgaatctacttacgcagtaatgataagaaatcttcttaaagatggagcggtggaagatgctaacgatatgttttcatcaatggacaagagtggtatagtccccagctcccatcttataaatgatatcatcagaatgttgctggaaagaggtgagatcgccaatgctggaaattatttgtctaaagttgatgggaagagcatctcacttgaagcttcaacgacttcattaatgttgtcccttttttcaagagaagggaaatatcgggaggacatgaaattgcttcctgcaaagtatcaatttttcgatggactttgt

SEQ ID NO: 1734 - DNA, 2442 bp, Triticum aestivum
atgtacctcatccacctccacctccaccgccgcctcttctcctccaccgcgcggccctcgcgaccctcgcgtgcctggtctccccacgccgcctttgctgcggccacggagcgcgtccgcgccgggaatttcagctgggaagacgcacacaacctgttcgacgaatcgctacggcgggccaccccggtccccgagcgctccctcgacggcttctgtgccgccctcgcccgtgggcacgcctccgaagcctgcagagatggtcccgccctcgccctcgctctcttcaaccacgtctgccgggacgaatccggcgcgcgggtggcaccacccacaatcttcacgtacggcattctcatgaactgctgctgtcgtgcgcatcgcccggacctagggctagccttcttcggtcgcctcctcaggacgggcctgaaggctgacctgatcgtcgccaacaccctccttaagtgtctctgccgcgcgaaacggacggatgaggctgtgaacgtgctgcttcataggatgtccgagctcggctgtgtgcctgatgccttctcatactccattgttctcaagagcttatgcgacaatggcatgagtcagcaggcgctcgacctgctgcatatgatggcgaaagaaggaggtggctgctcccccgacgtggtggcgtatagcacagtcatccatggcttctttaaggaaggtgaaacaggcaaggcatgcaatctgttccatgaaatgttgcagcaaggtgttgagcccaatgtgtggacatatagttcaatcattgatgcattgtgcaaggccagagcaatggacaaggcagagctagtgcttcagcagatggttaacaaaggtgttcaacccgataatgtgacatataattgcatgatccatggatattccacatctgggcggtggaaagaggctgttaaattgtttagagaaatgaaaagccggggccttataccagataattttacttgcaactccttaatgacttacctttgtaagcatggaagaagcaaagaaggtgcagaattttttgatgccatgactgccaaagggcacagagatgtcatctcctactgtgttttgcttcatgggtatgccaatgaaggatgctttgctgatatgattgatctctttaattcaatggaaagaaacggtattgctgccaactgctatgttttcaacatattagttaatggatatgctaaacgtggaatgacggatgaagctatgctgatatttacagaaatgtgggaaaaaggagtgagtcccaatgtagtcacatattccactgtaatagctgcactttccaggatgggtaggttgactgattctatggacaaatttaatcagatgattgccatgggaattcagccaaacacagctgtttatcactccctaattcagggttgtcttatgcatggtggcttggttaaagctaaggagctgatgtttgaaatgatgaacaaaggtattccttgtcctaacattgttttcttcagttcagtaataaacagtctgtgcaaagaaggaagggttatggatgcacatgatgtctttgacttggctataggcataggtgagaggcctaatgtcattatatttaattcactgattgacggatattgcttagttgggaagatggataaagcattcaaaatacttcatgtcatggaatcagttggtgttgagtctgatgttgttacttatagtgcacttcttgatggctattttaaaaacagaaggattgatggtgctttgactttgtttagagaaatgccgcgcaagagaattaaacctgacactgttacatataacatcatgttggatgggttgtttcgtgctgggagaactgtcgctgcaatggaaatgttccatgagatgactgaaagtggagcaacagtgcgcatttccacatacaatataatacttggaggtctttgtagaaatagttgtgtagatgaagcgattgcactgttccagaaattgcaagcaatgaatgtgaagttcattattgaaatattcaataccatgattgatgcaatgtacaaggttcaaagaaaagaagaagctaaggatttgtttgctgcaataccagctagtgggttggtgcccaatgaatctacttatgcagtaatgataagaaatcttctaaaagacggagcagtggaagatgctgacaatatgttttcatcaatggacaacagtggtatcgttcccagttcccgtcttataaatgatatcatcagaatgttgttggaaaaaggtgagatagccaaggctggaaattatttgtctaaagttgatgggaagagtatctcacttgaagcgtcaactacctcattgatgttgtctctcttttcaaggaaagggaaacatctggaggatattaagttgctcccagcaaactatcaatttttcgatggatttggt

SEQ ID NO: 1735 - DNA, 2442 bp, Triticum aestivum
atgtctctcatccacctccacctccaccgccgcctcttctcctccaccgcgcggccctcgcgaccctcgcgtgcctggtctccccacgccgcctttgctgcggccacggagcgcgtccgcgccgggaatttcagctgggaagacgcacacaacctgttcgacgaattgctacggcgggccaccccggtccccaagcgctccctcgacggcttccttgccgccctcgcccgtgcgcacgcctccgaagcctgcagagatggtcccgccctcgccctcgctctcttcaacctcgtctgccgggatgaatccggcgcgcgggtggcaccgcccacaatcttcacgtacggcattctcatgaactgctgctgtcgtgcgcattgcccggacctagggctagccttcttcgggcgcctcctcaggacgggcctgaaggctgacctgatagtcgccaacaccctccttaagtgtctctgccacgcgaaacggacggatgaggctgtgaacgtgctgcttcataggatgtccaagctcggctgtgtgcctgataccttctcatacaacattgttctcaagagcttatgcgacaatggcatgagccagcaggcgctcgacctgctccatatgatggcgaaagaaggaggtggctgcccccctgacgtggtggcgtatagcacagtcatccatggcttctttaaggaaggtgaaacaggcaaggcatgcaatctgttccatgaaatgatgcatcaaggtgttgagcccaatgtgtggacatatagttcaatcattgatgcattgtgcaaggccagagcaatggacaagacagagctagtgcttcagcagatggttaacaaaggtgttcaacccgataatgtgacatataattgcatgatccatggatattccacatctgggaggtggaaagaggctgttaaattgtttagagaaatgaaaagccggggccttataccagatatttctacttgcaactccttaatgacttacctttgtaagcatggaagaagcaaagaaggtgcagaattttttgatgccatgactgccaaagggcacagagatgtcatctcctactgtattttgcttcatgggtatgccaatgaaggatgctttgctgatatgattgatctctttaattcaatggaaagaaacggtattgctgccaactgctatgttttcaacatattaattaatggatatgctaaatgtggaatgacggatgaagctatgctgatatttacagaaatgtgggaaaaaggagtgagtcccaatgtagtcacatattccactgtaatagctgcactttccaggatgggtaggttgactgattctatggacaaatttaatcagatgattgccatgggaattcagccaaacacagctgtttatcactccctaattcagggttgtcttatgcatggtggcttggttaaagctaaggagctgatgtttgatatgatgaacaaaggtattcctcgtcctaacattgttttcttcagttcagtaataaacagtctgtgcaaagaaggaagggttatggatgcacatgctgtctttgacttggctataggcataggtgagaggcctgatgtcattacatttaattcactgattgacggatattgcttagttgggaagatggatacagcattcaaaatacttgatgtcatggaattagttggtgttgagcctgatgttgttacttatagtgcacttcttgatggctattttaaaaacagaaggattgatgatgctttgactttttttagagaaatgccatgtaagagaattaaacctaacactgttacatatggcatcatgttgggtgggttgtttcgtgctgggagaactgttgctgcaatgaaaatgttccatgagatgattgaaagtggagcaacagtgcgcatttccacatacaatataatacttggaggtctttgtcaaactaattgtgtagacgaagcgattgcactgttccagaaattacgagcaatgaatgtgaagttcaatattgaaacactcaataccatgattaatgcaatgtacaaggttcaaagaaaagaagaagctaaggatttgtttgctgcaataccagctagtgggttggtgcccaatgaatctacttatgcagtaatgataagaaatcttctaaaagacggagcagtggaagatgctgacaatatgttttcatcaatggacaacagtggtatcgttcccagttcccgtcttataaatgatatcatcagaatgttgttggaaaaaggtgagattgctaaggctggaaattatttgtctaaagttgatgggaagagtatctcacttgaagcgtcaactacctcattgatgttgtctctcttttcaaggaaagggaaacatctggaggatattaagttgctcccagcaaagtatcaatttttcgatggatttggt

SEQ ID NO: 1736 - DNA, 2442 bp, Triticum aestivum
atgtctctcatccacctccacctccaccgccgcctcttctcctccaccgcgcggccctcgcgaccctcgcgtgcctggtctccccacgccgcctttgctgcggccacggagcgcgtccgcgccgggaatttcagctgggaagacgcacacaacctgttcgacgaattgctacggcgggccaccccggtccccaagcgctccctcgacggcttccttgccgccctcgcccgtgcgcacgcctccgaagcctgcagagatggtcccgccctcgccctcgctctcttcaacctcgtctgccgggatgaatccggcgcgcgggtggcaccgcccacaatcttctcgtacggcattctcatgaactgctgctgtcgtgcgcattgcccggacctagggctagccttcttcgggcgcctcctcaggacgggcctgaaggctgacctgatagtcgccaacaccctccttaagtgtctctgccacgcgaaacggacggatgaggctgtgaacgtgctgcttcataggatgtccaagctcggctgtgtgcctgataccttctcatacaacattgttctcaagagcttatgcgacaatggcatgagccagcaggcgctcgacctgctccatatgatggcgaaagaaggaggtggctgcccccctgacgtggtggcgtatagcacagtcatccatggcttctttaaggaaggtgaaacaggcaaggcatgcaatctgttccatgaaatgatgcatcaaggtgttgagcccaatgtgtggacatatagttcaatcattgatgcattgtgcaaggccagagcaatggacaagacagagctagtgcttcagcagatggttaacaaaggtgttcaacccgataatgtgacatataattgcatgatccatggatattccacatctgggaggtggaaagaggctgttaaattgtttagagaaatgaaaagccggggccttataccagatatttctacttgcaactccttaatgacttacctttgtaagcatggaagaagcaaagaaggtgcagaattttttgatgccatgactgccaaagggcacagagatgtcatctcctactgtattttgcttcatgggtatgccaatgaaggatgctttgctgatatgattgatctctttaattcaatggaaagaaacggtattgctgccaactgctatgttttcaacatattaattaatggatatgctaaatgtggaatgacggatgaagctatgctgatatttacagaaatgtgggaaaaaggagtgagtcccaatgtagtcacatattccactgtaatagctgcactttccaggatgggtaagttgactgattctatggacaaatttaatcagatgattgccatgggaattcagccaaacacagctgtttatcactccctaattcagggttgtcttatgcatggtggcttggttaaagctaaggagctgatgtttgatatgatgaacaaaggtattcctcgtcctaacattgttttcttcagttcagtaataaacagtctgtgcaaagaaggaagggttatggatgcacatgctgtctttgacttggctataggcataggtgagaggcctgatgtcattacatttaattcactgattgacggatattgcttagttgggaagatggatacagcattcaaaatacttgatgtcatggaatcagttggtgttgagcctgatgttgttacttatagtgcacttcttgatggctattttaaaaacagaaggattgatgatgctttgactttttttagagaaatgccatgtaagagaattaaacctaacactgttacatatggcatcatgttgggtgggttgtttcgtgctgggagaactgttgctgcaatgaaaatgttccatgagatgattgaaagtggagcaacagtgcgcatttccacatacaatataatacttggaggtctttgtcaaactaattgtgtagacgaagcgattgcactgttccagaaattacgagcaatgaatgtgaagttcaatattgaaacactcaataccatgattaatgcaatgtacaaggttcaaagaaaagaagaagctaaggatttgtttgctgcaataccagctagtgggttggtgcccaatgaatctacttatgcagtaatgataagaaatcttctaaaagacggagcagtggaagatgctgacaatatgttttcatcaatggacaacagtggtatcgttcccagttcccgtcttataaatgatatcatcagaatgttgttggaaaaaggtgagatagctaaggctggaaattatttgtctaaagttgatgggaagagtatctcacttgaagcgtcaactacctcattgatgttgtctctcttttcaaggaaagggaaacatctggaggatattaagttgctcccagcaaagtatcaatttttcgatggatttggt

SEQ ID NO: 1737 - DNA, 2442 bp, Triticum aestivum; identical to SEQ ID NO: 1735

SEQ ID NO: 1738 - DNA, 2442 bp, Triticum aestivum; identical to SEQ ID NO: 1735

SEQ ID NO: 1739 - DNA, 2442 bp, Triticum aestivum; identical to SEQ ID NO: 1735

SEQ ID NO: 1740 - DNA, 2442 bp, Triticum aestivum; identical to SEQ ID NO: 1736

SEQ ID NO: 1741 - DNA, 2316 bp, Triticum aestivum
atgccgaccacccgcctgtcctccgtctccgcctcctccttcaaggcttcttcacgaaaaccacgagcccccctcgccgccttggctgctgccacggagcgtgtgcgcgccggaacactaagccaggaggacgcgcaccacctgttcgacaaattgctaggccaagccaccgccgtcccggaacgcgggctgaacaactttcttgccgcactagcccgtgcatcgccctcggctacctgcagcgatggccccggccttgctgtcaccctcttcaaccgcatgtcccttggcgctggtgcacgggtggcgtcgcccacactctgtacctattccatcctcatggactgctgctgccgtgcaggccgcccagacttggtggtcacctttttcggccgcctcctcaggttggggctgcgcttgaatgtcgtctccttcaacaacctcctcaaggggctttgccaggccaagcgctcaaatgaggcattggatctgctgctccaccggatgcccgaactggaccgtgcgcctgatgtcttctcgttcaacatagtaatcaatggctgctttagagaaggtgaagtagacaaagcatgcaatctcttccatgagatgccccaactgggagttcaacctgatgtggtgacctacaactcaattatcatcgcactaagcagggccggagcaatgggtaaggcagaagtggtccttcggcaaatggttgataaaggcattggacccgatgtcatgacatatagcagtctgatccatggatattctacttcgggtcagtggaaggcagcagttagggtattcaaagagatggtaagtgttggtgttcgaccaaatgctgtcacgttgaactcatttatggattcactttgcaagcatagaaggacaaaggaagctagagatatttttgactccatggctgcaaagggccacaaacctaatattgtctcctactctactatgcttaatgggtatgcgaaacaaggatgcttcgatgatatgactggtctcttcaattccatggtacagaacggtattgtacctaacaaccatgttttcaacatactgatcagagcatattctacacgtggactgatggatgaggctatgcacatgttcgaagtaatgaagcaacaaggagtaaacccagatgtagttgactatctagtagtaatagattccctttgcaaaatgggcaggatggatgctgctatggacaaatttaatcagatggtcaatcaaggagtttcacctgatataggcatttaccaatgcctggttctgggttcttgctctaatggtgattttgtgaaagccaaggaattgatttctgaagcagttaatcgaggtctgtgttataacagtgtgttcttctatcctgtaataaacaacctgagcaaagaaggaaatgtaaaggatgcacaggatatgtttgacttcattgtaggtattggtcatcagcctgatgttattatgtacaattcactgatggatggatattgccttgttggcaaggtggaggaagcactgacagtgcttgacgctatgaagtccgctgacctccaacctgatgctattacatatgttatacttcttaatggctactgtaaaattggaaggatcgacgatggattgagtcttttcagggaaatgtcactcagcggggttaagcccacgactattatgtacaacattgcacttgatgggctgtttcgctctaggagaacagtttctgcaaaggaaaaattccatacgattattgaaagtggcataccagtggacgttggcacatacaccatagttcttagtggactttgcaaaaataattgcactgatgaagcaatagagctgttcaacaaattacgtgctatgaacatgaagattaatgtcataatactcaataccatgatttctgcaatgtttaaaactaggagaattgaagaagccaaggatttgtttgctactataccagccattgggttggtgccttctgttgtgacctacactgtaatgatgacgaatttcataaaagaagggttgctggcagaggctgatgatatgtttttagcaatggagaaggctggctgtgctcctgactgcaggctgctaaatcatgtagtcagggtgttgctggaaaaaggtgcagttgtaaaggctgcaacttatcttgctaaacttgatgcgaaagagctgtcacttgaagcttcaacggtttcgttaatagtatctctcttctcaaggagaggcaaattaagggagcacgtaaaattgcttccggtaaagtaccagcctcctgagatgttgggc

SEQ ID NO: 1742 - DNA, 1317 bp, Triticum aestivum
atgattaatctctttaattcaatggaaggcaatggtattgtagctgactgcaatgttttcaacatattaattgatgcatatgctaaatgtggaatgatgcatgaagctatgctcatatttaccaaaatgcgggaacaaggagtgagtccgaatgtatgcacctatgcaactgtaatagctgcactttgcagaatgggtaggctgtctgatgcaatgggcaaattaaatgagatgattgctacgggattacaaccggacgtggctatttatacatccctaattcagggcttctgtacacatggtgatttggggaaagtgaaggagctggtttctgaaatgatgaacaaaggtatgcctcgtccaaacattgtgttcttcagctcagtaataaacagtctatgcaaagaaggaagagttacagatgtacacagtatcttcgacttggctataaacattggtgagaggcctgacgttattacatttacttcactgattgacggatattgtttagttggcaagatggataaagcattcaaagtacttgatgacatggtatcagctggcattgagcctgatgtttatacatatactacccttcttgatggctattctagaaatggaaggattgatgatgggttgacactattcagcgaaatgatgcataaaaaaattaaacctacaactgctacatatggcaccttactaaatgggttgtttcgtgcttggagaactgcttctgcgaagaaaatgatccatgagatgattgaaagtggaacaacagtgagcctttcaatatacgctataattcttgaaggacttcgtagaaataattgcactgatgaagcaatcacgctgttccagaaagtacgtgcaatgaatataaaattggatgttgcaatactcaataccatgatcaatgcaatgtttaaggttcaaagaagagaagaagctaatgatttgtttgcttcaatatcggccagtggattggtacctaatgcttctacctaccgcacaatgataacaaatcttctaaaagaaggattagtggaagaagctgaaaacatgctctcatcaatggagaagagctgttgtgctccggactctcgtcttattaatgataccatcagaatattattggaacaaggtgaggtcgtcaaggctggaaattatatgtctagagttgatggcaagagcatctcacttgaagcttcaactacttcgctgctgatacgtctcttttcaagggaaggaaaatatagggagaaaataaaattgctccctgtaaagtatcaattttttggtggagctacagttgag

SEQ ID NO: 1743 - DNA, 1317 bp, Triticum aestivum; identical to SEQ ID NO: 1742

SEQ ID NO: 1744 - DNA, 2478 bp, Triticum aestivum
atgagaaataaaaaaaaatcacatgaggaggccattttacccgcttccgatttgttacagcaaagactcctcaccattccaccagcgcgaacacgaaggccgtgcccgtcccatgcctcgcctctaccccaccacgcccatgctccgcctcctctcctccgccgccgccgcctctcctcctcctccacctcgtcgccttcacgccgctgggacccccgagccgcctttgccgcggccacggagcgcgtccgcgccgggacgctcagccctgaagacgcacaccacctgttcgacgaattgctactgcaggccaacccggtcccctaccgctccctcaacggcttccttgccgcgctcgcccgtgctccgtcctccgctgctctcagagatggaccctcccttgctctcgccctcttcaaccgcgtctgccgagaagaagcaggaccgcgggtggcgccgcccacagtctgcacctacagcatcctcatggacagctgctgccgtgcatgccgcccgaacctaggccttgctttcttcggccgcttcctcaggacgggcctcaaggcagaccagatcgtcgccagcaacctcctcaagtgcctctgccacgcaaaacggacggatgaggctgtcaacatgctgcttcataggatgtccgagttcggatgtgtgcctaatgtcatctcatactctatagtacttaagagcttatgtgacgatagcaggagccagcaagcgctcgacttgctccagatggtgaggaaagaaggaggtgcctgctccttcaatgtggtggcatatagcacggtcatccacggcttctttaaggaaggggaagtaagcaaggcatgcgatctgttccatgaaatgatgcagcaagggattgtgcctaatgtggtgacatatagctcgattattgatgccttgtgcaaggtcagggcaatggacaaggcaaagctggtccttcagcagatggttgataatggtgttcgaccaaatatgtatacatggaactcattcatgtactccctttgcaagaatggaagaagcaaagaagctgcagaattttttgactccatgacctccaagggcctcaaacctaatatcatcgtgtactctactcttcttcacgggtatgctaccgaaggatgcttagctgatatgattaatctctttaattcaatggaaggcaatggtattgtagctgactgcaatgttttcaacatattaattgatgcatatgctaaatgtggaatgatgcatgaagctatgctcatatttaccaaaatgcgggaacaaggagtgagtccgaatgtatgcacctatgcaactgtaatagctgcactttgcagaatgggtaggctgtctgatgcaatgggcaaattaaataagatgattgctacgggattacaactggacgtggctatttatacatccctaattcagggcttctgtacacatggtgatttggggaaagtgaaggaactggtttctgaaatgatgaacaaaggtatgcctcgtccaaacattgtgttcttcagctcagtaataaacagtctatgcaaacaaggaagagttacagatgcacacagtatcttcgacttggctataaacattggtgagaggcctcacgtcattacatttacttcactgattgacggatattgtttagtttgcaagatggataaagcattcaaagtacttgatgccatggtatcggctggcatcgagcctgatgtttatacatatactacccttcttgatggctattctagaaatggaaggattgatgatgggttgacactattcagtgaaatgatgcataacaaaactaaacctacaactgctacacatggcaccttactaaatgggttgtttcgtgctgggagaactgcttctgcgaagaaaatgatccatgagatgattgaaagtggaacaacagtgagcctttcaatatacgctataattcttgaaggactttgtagaaataattgcgccgatgaagcaatcacgctgttccagaaagtacgtgcaatgaatataaaattggatgttgcaatactcaataccatgatcaatgcaatgtttaaggttcaaagaagagaagaagctaatgatttgtttgcttcaatatcggccagtggattggtacctaatgcttctacctaccgcacaatgataacaaatcttctaaaagaaggattagtggaagaagctgaaaacatgctctcatcaatggagaagagctgttgtgctccggactctcgtcttattaatgatatcatcagaatattattggaacaaggtgaggtcgtcaaggctggaaattatatgtctagagttgatggcaagagcatctcacttgaagcttcaactacttcgctgctgatacgtctcttttcaagggaaggcaaatatagggagaaaataaaattgctccctgtaaagtatcaattttttggtggagctacagttgag

SEQ ID NO: 1745 - DNA, 1317 bp, Triticum aestivum; identical to SEQ ID NO: 1742

SEQ ID NO: 1746 - DNA, 1317 bp, Triticum aestivum
atgattaatctctttaattcaatggaaggcaatggtattgtagctgactgcaatgttttcaacatattaattgatgcatatgctaaatgtggaatgatgcatgaagctatgctcatatttaccaaaatgcgggaacaaggagtgagtctgaatgtatgcacctatgcaactgtaatagctgcactttgcagaatgggtaggctgtctgatgcaatgggcaaattaaatgagatgattgctacgggattacaaccggacgtggctatttatacatccctaattcagggcttctgtacacatggtgatttggggaaagtgaaggagctggtttctgaaatgatgaacaaaggtatgcctcgtccaaacattgtgttcttcagctcagtaataaacagtctatgcaaagaaggaagagttacagatgcacacagtatcttcgacttggctataaacattggtgagaggcctgacgttattacatttacttcactgattgacggatattgtttagttggcaagatggataaagcattcaaagtacttgatgccatggtatcagctggcattgagcctgatgtttatacatatactacccttcttgatggctattctagaaatggaaggattgatgatgggttgacactattcagcgaaatgatgcataaaaaaattaaacctacaactgctacatacggcaccttactaaatgggttgtttcgtgctgggagaactgcttctgcgaagaaaatgatccatgagatgattgaaagtggaacaacagtgagcctttcaatatacgctataattcttgaaggacttcgtagaaataattgcactgatgaagcaatcacgctgttccagaaagtacgtgcaatgaatataaaattggatgttgcaatactcaataccatgatcaatgcaatgtttaaggttcaaagaagagaagaagctaatgatttgtttgcttcaatatcggccagtggattggtacctaatgcttctacctaccgcacaatgataacaaatcttctaaaagaaggattagtggaagaagctgaaaacatgctctcatcaatggagaagagctgttgtgctccggactctcgtcttattaatgatatcatcagaatattattggaacaaggtgaggtcgtcaaggctggaaattatatgtctagagttgatggcaagagcatctcacttgaagcttcaactacttcgctgctgatacgtctcttttcaagggaaggaaaatatagggagaaaataaaattgctccctgtaaagtatcaattttttggtggagctacagttgag

SEQ ID NO: 1747 - DNA, 2478 bp, Triticum aestivum; identical to SEQ ID NO: 1744

SEQ ID NO: 1748 - DNA, 1992 bp, Triticum aestivum
atggacagctgctgccgtgcatgccgcccgaacctaggccttgctttcttcggccgcttcctcaggacgggcctcaaggcagaccagatcgtcgccagcaacctcctcaagtgcctctgccacgcaaaacggacggatgaggctgtcaacatgctgcttcataggatgtccgagttcggatgtgtgcctaatgtcatctcatactctatagtacttaagagcttatgtgacgatagcaggagccagcaagcgctcgacttgctccagatggtgaggaaagaaggaggtgcctgctccttcaatgtggtggcatatagcacggtcatccacggcttctttaaggaaggggaagtaagcaaggcatgcgatctgttccatgaaatgatgcagcaagggattgtgcctaatgtggtgacatatagctcgattattgatgccttgtgcaaggtcagggcaatggacaaggcaaagctggtccttcagcagatggttgataatggtgttcgaccaaatatgtatacatggaactcattcatgtactccctttgcaagaatggaagaagcaaagaagctgcagaattttttgactccatgacctccaagggcctcaaacctaatatcatcgtgtactctactcttcttcacgggtatgctaccgaaggatgcttagctgatatgattaatctctttaattcaatggaaggcaatggtattgtagctgactgcaatgttttcaacatattaattgatgcatatgctaaatgtggaatgatgcatgaagctatgctcatatttaccaaaatgcgggaacaaggagtgagtccgaatgtatgcacctatgcaactgtaatagctgcactttgcagaatgggtaggctgtctgatgcaatgggcaaattaaataagatgattgctacgggattacaaccggacgtggctatttatacatccctaattcagggcttctgtacacatggtgatttggggaaagtgaaggaactggtttctgaaatgatgaacaaaggtatgcctcgtccaaacattgtgttcttcagctcagtaataaacagtctatgcaaagaaggaagagttacagatgcacacagtatcttcgacttggctataaacattggtgagaggcctgacgtcattacatttacttcactgattgacggatattgtttagttggcaagatggataaagcattcaaagtacttgatgccatggtatcggctggcatcgagcctgatgtttatacatatactacccttcttgatggctattctagaaatggaaggattgatgatgggttgacactattcagcgaaatgatgcataacaaaattaaacctacaactgctacacatggcaccttactaaatgggttgtttcgtgctgggagaactgcttctgcgaagaaaatgatccatgagatgattgaaagtggaacaacagtgagcctttcaatatacgctataattcttgaaggactttgtagaaataattgcgccgatgaagcaatcacgctgttccagaaagtacgtgcaatgaatataaaattggatgttgcaatactcaataccatgatcaatgcaatgtttaaggttcaaagaagagaagaagctaatgatttgtttgcttcaatatcggccagtggattggtacctaatgcttctacctaccgcacaatgataacaaatcttctaaaagaaggattagtggaagaagctgaaaacatgctctcatcaatggagaagagctgttgtgctccggactctcgtcttattaatgatatcatcagaatattattggaacaaggtgaggtcgtcaaggctggaaattatatgtctagagttgatggcaagagcatctcacttgaagcttcaactacttcgctgctgatacgtctcttttcaagggaaggcaaatatagggagaaaataaaattgctccctgtaaagtatccattttttggtggagctacagttgag

SEQ ID NO: 1749 - DNA, 1317 bp, Triticum aestivum; identical to SEQ ID NO: 1742

SEQ ID NO: 1750 - DNA, 1317 bp, Triticum aestivum; identical to SEQ ID NO: 1742

SEQ ID NO: 1751 - DNA, 1992 bp, Triticum aestivum; identical to SEQ ID NO: 1748

SEQ ID NO: 1752 - DNA, 1317 bp, Triticum aestivum; identical to SEQ ID NO: 1742

SEQ ID NO: 1753 - DNA, 1992 bp, Triticum aestivum; identical to SEQ ID NO: 1748

SEQ ID NO: 1754 - DNA, 1992 bp, Triticum aestivum; identical to SEQ ID NO: 1748

SEQ ID NO: 1755 - DNA, 2460 bp, Triticum aestivum
atgtcccgcctccgccactccacctccaccgcgccgatgttccacctccgcctcctccgctgccgcttctcctccatctccaccttgccgccgtcacgctcatggtctccccatgcagcctttgccgcggccacagagcgcgtcatcgctgggacgctcagcccggaggacgcacaccgcctgttcgacgaattgctacggcaggccactccggtccccgcgcgctccctgaacggcttcctcacggccctctcccgtgcgccggacaccggcgcctgcagagacggccccgccctcttcaaccgcacccgccgagaagaggccggctcccgggtggtgtcgtccacaatcttcacctacggcatcctcatgaactgctgcggccgcacgcgtcgtccggaacttgggcttgccttctttgggcgcgtcctcaggatgggcctgaagacaaatgtggtcgtcgccaccatggtcctccagtgcctctccagcgccaaacggacagatgaggctgtggacatcctgctacatcggatctccgagctcgggtgcgtgcctgacgccttctcatactccattgttctgaagagcttatgcgatgatagcaggagccagcgggcactcgacctgctccacatgtgggagaaagaacgaggtgtctgctcccccaacgtagtgacgtataacacgggcatccacggcttctttaaggaaggtgaagtaagcaaggcatgcaatctattccatgaaatggtgcagaaaggggttgaacctaatgtggtgacatatagcttgaccattgatgcgctgtgcaaggccagagctatggacaaagcagagttgttcctccggcagatgattgataaaggtgttcaaccgaacaatgtgacatataatgtcatgatccatggatattccactctgggccagtggaaagaagcgggtaaaatgttcagagaaatgacaagacagggtctcataccagatcttgttacttggacctcgttcatggcctctctctgtaagcatggaagaaccaaagaagctgccgaattttttgattccatgactgccaagggccacaagcctgatttggtcacgtaccatgttctgctccatgggcatgcaaccgaaggatgctttgctgatatgattaatctctttaatgcaatggcaaccaaaggtattctacccgaccgtcaggttttcaacattttaattgatgcacatgctaaacatcgaatgatggatgaagctatgcacatatttactggaatgcaggggcaaggagtgtgtccagatgtatggacctattcaactctaatatctgcactttgcagaatgggtaggctggctgatgccatggataacttcagtcagatgattggtaagggagtacaactgaacacagttgtttatcactccctaattcagggtttctctacacatggtgatttgaggaaagcaaaggagttggtttatgaaatgacgaacaaaggtattccttgtccaaacattgcattcttcagttctataatggacagtctatgcaaagaaggaagggttatggatgcacatgatatcttccacttggttacagacataggtctgaaacctaacatcattacgtttaatacgctgattgatggatattgcttagtcggtgagatggagaaagcatttggagtacttgattccatggtatcagctggcattgaggctgatgtttttacatataatacacttgcttatggctattgtagatgtggaaggactgatgatgggttgattctcttcagagaaatggtgcaaaacaaacctaagcccacaacaatcacatataacatcatactggatgggttatttcgtgctgggagaacatttgctgcaaagaaaatgttccttgagatgaccgaaacgggaataacagtgagcatttccacatacagtataatacttggaggactttgtaggaataattgctctgacgaagcgatcaccctatttcagaaattaggagcaatggatgtgaagtttgatattaaaatactcaataccatgatcaatgccatgttcaaggttcggagaagagaagaagctaacggtttgtttgctggaatatcagccagtaggatggtacctaatgcttctacctacagcgtaatgataggaaatcttctaaaagaaggatcagtggaagaagctgaaaatatgttctcattaatggagaagagtggttgtgctccagactctcgtcttataaataatatcatcagaatattattggaaaacggtgacatcgtcaaggctggaaattatatgtctaaagttgatggcaagagcatctcacttgaagcttcaactacttcgttgttgatgtgtctcttttcaagtaaagggaaatatcgggaacaaatcagtttgctccctgtaaattaccaatttttcaatggagtcagt

SEQ ID NO: 1756 - DNA, 2460 bp, Triticum aestivum; identical to SEQ ID NO: 1755

SEQ ID NO: 1757 - DNA, 2472 bp, Triticum aestivum
atgtcccgcctccgccactccacctccaccgtgccgatgttccacctccgcctcctccgctgccgcttctcctccatctccaccttgccgccgtcacgctcatggtctccccatgcagcctttgccgcggccacagagcgcgtcatagctgggacgctcagcccggaggacgcacaccgcctgttcgacgaattgctacggcaggccactccggtccccgcgcgctccctgaacggcttcctcacggccctctctcgtgcgccggacaccggcgcctgcagagacggccccgccctcgccctcgccctcttcaaccgcacccgccgagaagaggccggctcccgggtggtgtcgtccacaatcttcacctacggcatcctcatgaactgctgccgccgcacgcgtcgtccggaacttgggcttgccttctttgggcgcgtcctcagaatgggcctgaagacaaatgtggtcgtcgccaccatggtcctccagtgcctctgcagcgccaaacggacagatgaggctgtggacatcctgctacatcggatgtccgagctcgggtgcgtgcctgacgccttctcatactccattgttctgaagagcttatgcgatgatagcaggagccagcgggcactcgacctgctccacatgtgggagaaagaacgaggtgtctgctcccccaacgtagtgacgtataacacggtcatccacggcttctttaaggaaggtgaagtaagcaaggcatgcaatctattccatgaaatagtgcagaaaggggttgaacctaatgtggtgacatatagcttgaccattgatgcgctgtgcaaggccagagctatggacaaagcagagttgttcctccggcagatgattgataaaggtgttcaaccgaacaaagtgacatataatgtcatgatccatggatattccactctgggccagtggaaagaagcgggtaaaatgttcagagaaatgacaagacagggtctcataccagatcttgttacttggacctcgttcatggcctctctctgtaagcatggaagaaccaaagaagctgccgatttttttgattccatgactgccaagggccacaagcctgatttggtcacgtaccatgttctgctccatgggcatgcaaccgaaggatgctttgctgatatgattaatctctttaatgcaatggcaaccaaaggtattctacccgaccgtcaggttttcaacattttaattgatgcacatgctaaacatggaatgatggatgaagctatgcacatatttactggaatgcaggggcaaggagtgtgtccagatgtatggacctattcaactctaatatctgcactttgcagaatgggtaggctggctgatgccatggataacttcagtcagatgattggtaagggagtacaaccgaacacagttgtttatcactccctaattcagggtttctctacacatggtgatttgaggaaagcaaaggagttggtttatgaaatgacgaacaaaggtattccttgtccaaacattgcattcttcagttctataatggacagtctatgcaaagaaggaagggttatggatgcacatgatatcttccacttggttacagacataggtctgaaacctaacatcattacgtttaatacgctgattgatggatattgcttagtcggtgagatggagaaagcatttggagtacttgattccatggtatcagctggcattgaggctgatgtttttacatataatacacttgcttatggctattgtagatgtggaaggattgatgatgggttgattctattcagagaaatggtgcaaaacaaacctaagcccacaacaatcacatataacatcatactggatgggttatttcgtgctgggagaacatttgctgcaaagaaaatgttccttgagatgaccgaaacgggaataacagtgagcatttccacatacagtataatacttggaggactttgtaggaataattgctctgacgaagcgatcaccctatttcagaaattaggagcaatggatgtgaagtttgatattaaaatactcaataccatgatcaatgccatgttcaaggttcggagaagagaagaagctaacggtttgtttgctggaatatcagccagtaggatggtacctaatgcttctacctacagcgtaatgataggaaatcttctaaaagaaggatcagtggaagaagctgaaaatatgttctcattaatggagaagagtggttgtgctccagactctcgtcttataaataatatcatcagaatattattggaaaacggtgacatcgtcaaggctggaaattatatgtctaaagttgatggcaagagcatctcgcttgaagcttcaactacttcgttgttgatgtgtctcttttcaagtaaagggaaatatcgggaacaaatcagtttgctccctgtaaattaccaatttttcaatggagtcagt

SEQ ID NO: 1758 - DNA, 2460 bp, Triticum aestivum; identical to SEQ ID NO: 1755

SEQ ID NO: 1759 - DNA, 2460 bp, Triticum aestivum; identical to SEQ ID NO: 1755

SEQ ID NO: 1760 - DNA, 2460 bp, Triticum aestivum
atgtcccgcctccgccactccacctccaccgcgccgatgttccacctccgcctcctccgctgccgcttctcctccatctccaccttgccgccgtcacgctcatggtctccccatgcagcctttgccgcggccacagagcgcgtcatcgctgggacgctcagcccggaggacgcacaccgcctgttcgacgaattgctacggcaggccactccggtccccgcgcgctccctgaacggcttcctcacggccctctcccgtgcgccggacaccggcgcctgcagagacggccccgccctcttcaaccgcacccgccgagaagaggccggctcccgggtggtgtcgtccacaatcttcacctacggcatcctcatgaactgctgcggccgcacgcgtcgtccggaacttgggcttgccttctttgggcgcgtcctcaggatgggcctgaagacaaatgtggtcgtcgccaccatggtcctccagtgcctctccagcgccaaacggacagatgaggctgtggacatcctgctacatcggatgtccgagctcgggtgcgtgcctgacgccttctcatactccattgttctgaagagcttatgcgatgatagcaggagccagcgggcactcgacctgctccacatgtgggagaaagaacgaggtgtctgctcccccaacgtagtgacgtataacacggtcatccacggcttctttaaggaaggtgaagtaagcaaggcatgcaatctattccatgaaatggtgcagaaaggggttgaacctaatgtggtgacatatagcttgaccattgatgcgctgtgcaaggccagaactatggacaaagcagagttgttcctccggcagatgattgataaaggtgttcaaccgaacaatgtgacatataatgtcatgatccatggatattccactctgggccaatggaaagaagcgggtaaaatgttcacagaaatgacaagacagggtctcataccagatcttgttacttggacctcgttcatggcctctctctgtaagcatggaagaaccaaagaagctgccgaattttttgattccatgactgccaagggccacaagcctgatttggtcacgtaccatgttctgctccatgggcatgcaaccgaaggatgctttgctgatatgattaatctctttaatgcaatggcaaccaaaggtattctacccgaccgtcaggttttcaacattttaattgatgcacatgctaaacatggaatgatggatgaagctatgcacatatttactggaatgcaggggcaaggagtgtgtccagatgtatggacctattcaactctaatatctgcactttgcagaatgggtaggctggctgatgccatggataacttcagtcagatgattggtaagggagtacaaccgaacacagttgtttatcactccctaattcagggtttctctacacatggtgatttgaggaaagcaaaggagttggtttatgaaatgacgaacaaaggtattccttgtccaaacattgcattcttcagttctataatggacagtctatgcaaagaaggaagggttatggatgcacatgatatcttccacttggttacagacataggtctgaaacctaacatcattacgtttaatacgctgattgatggatattgcttagtcggtgagatggagaaagcatttggagtacttgattccatggtatcagctggcattgaggctgatgtttttacatataatacacttgcttatggctattgtagatgtggaaggattgatgatgggttgattctcttcagagaaatggtgcaaaacaaacctaagcccacaacaatcacatataacatcatactggatgggttatttcgtgctgggagaacatttgctgcaaagaaaatgttccttgagatgaccgaaacgggaataacagtgagcatttccacatacagtataatacttggaggactttgtaggaataattgctctgacgaagcgatcaccctatttcagaaattaggagcaatggatgtgaagtttgatattaaaatactcaataccatgatcaatgccatgttcaaggttcggagaagagaagaagctaacggtttgtttgctggaatatcagccagtaggatggtacctaatgcttctacctacagcgtaatgataggaaatcttctaaaagaaggatcagtggaagaagctgaaaatatgttctcattaatggagaagagtggttgtgctccagactctcgtcttataaataatatcatcagaatattattggaaaacggtgacatcgtcaaggctggaaattatatgtctaaagttgatggcaagagcatctcacttgaagcttcaactacttcgttgttgatgtgtctcttttcaagtaaagggaaatatcgggaacaaatcagtttgctccctgtaaattaccaatttttcaatggagtcagt

SEQ ID NO: 1761 - DNA, 2475 bp, Triticum aestivum
atgccccgctcccgcctccgtcgctacgcctccaccatgccgatgtccagcctccgtcccctccaccgcagctcctcctccaccacgtcgcctgcacgcgcctggtccccccatgccgccttcgccgcggccacggagcgtgtccgcgccgggacggtcaggccggaagacgcacacaccctgttcgacgaattgcttcggcaggccacaccggtcccccagcgatccctgaacggcttccttgccgccctcgcccgtgcgcccgcctccggcgcctgcatcagagatggccccgcccttgcagtggctctcttcaaccgtgtgtgcagagacgaagccggcccgcaggtggcggcgctcacaggctgcacctacagcatcctcatggactgctgctgccgcgcccgtcgcccggacctagggcttgccttatttggccgcttcctcagggaaggcctgaagacagaccagatcgtcgccaacaccttcctcaagtgcctctgctacgcgaaacggacggatgaggcagtggacgtgctgcttcataggatgtccgagctcgggtgtgtgcctgatgccttctcatacaacactgtcctgaagagcttatgcgacaatggcatgagtcagcgggcgctcgacctgctccagaggatggcgaaagaaggaggtgtctgctctctcaatctggtggcatataacacggtcatccatggcttctttaaggaaggtgaaacaggcaaggcatgcagtctgttccatgaaatgatgcagcaaggtgttgtgcccaatgtgtggacgtatacctcgattattgatgcattgtgcaaggccagagcaatggacaaggcagagctagtccttcgtcagatggttgctaaaggtgctcaacctgatatagtgacatatacttgcatgatcaatggatatgccacatctgggcggttgaaagaggctgctaaaatgttcagagaaatgaaaagccggggtcttacaccaaatattgttacctgcggctcgttaatgacttacctttgcaagcatggaagaagcaaagaagctagagaaatatttgattccatgactgccaaaggccacagagctaatgtcgtctcgtactgtattttgcttcatgggtatgccaatgaaggatgctttgctgatatgattgatctctttaattcaatgaaaagcaacggtattgcagccgactgccgtgttttcaacatattaattaatggatatgctaaacgtggaaagatggatgaagctatgctcatatttacggaaatgtgggaaaaaggagtgagtcccgatgtggttacctattccactgtaatagctgcactttccaggatgggtagattgaccgatgccatggacaaatttaatcagatgatttccatgggggttcaaccgaacacagctgtttatcactccctaattcagggctcttgtatgcatggtgatttgattaaagccaaggagctggtttctgaaatgatgaacaaaggtattcctcgtcctagcattgcgttcttcggttcaataataaacaggttatgcaaagatggaagggttatggatgcacatgatatctttgacttggttatagacataggcgagaggcctagtgtcattacatttaattcactgattgacggatattgcttagtcgggaagatggataaagcatttaaaatactcgatgccatggaagtagttggtgttgagtctgatgttattacatatagtacacttcttgatggctattttaaaaatggaaggatcaatgatggtttgactctgtttagagaaatgccgcataagggaattaaacctgacactgtgacatatggcatcatgttggatgggttgtttcgtgctggcagaactgttgctgtaaggacagtgttccatgagatgatcgaaagtggaataacagtggacatccccacatacaatatagttcttggaggactttgtagaaataactgcacagatgaagcaatcgccctgttccagaaattaggtgcaatgagtgtgaagtccaatattgcaatactcaataccatgatcgatggaatgtacaaggttcggagaagagaagaagccaatgatttatttgctacaatatcagccagtggattggtgcccaatgaatctacttatgcagtaatgataataaatcttctaaaagatggagcagtggaagaagcagacaatatgttttcatcaatggagaaaactggtatagtccccagctcccgtctgttaaatcacatcatcagaatgttgttggaaataggtgagattgccaaggccggaaattacttgtctaaagttgatgggaagagcatctcacttgaagcgtcaacaacttcattgatgttgtctttcttttcgaagaaaggcaaatatcgggaggacatgaaattgctgcctgcaaagtttcaaatttttgatggatttggt

SEQ ID NO: 1762 - DNA, 2475 bp, Triticum aestivum
atgccccgctcccgcctccgtcgctacgcctccaccatgccgatgtccagcctccgtcccctccaccgcagctcctcctccaccacgtcgcctgcacgcgcctggtccccccatgccgccttcgccgcggccacggagcgtgtccgcgccgggacggtcaggccggaagacgcacacaccctgttcgacgaattgcttcggcaggccacaccggtcccccagcgatccctgaacggcttccttgccgccctcgcccgtgcgcccgcctccggcgcctgcatcagagatggccccgcccttgcagtggctctcttcaaccgtgtgtgcagagacgaagccggcccgcaggtggcggcgctcacaggctgcacctacagcatcctcatggactgctgctgccgcgcccgtcgcccggacctagggcttgccttatttggccgcttcctcagggaagacctgaagacagaccagatcgtcgccaacaccttcctcaagtgcctctgctacgcgaaacggacggatgaggcagtggacgtgctgcttcataggatgtccgagctcgggtgtgtgcctgatgccttctcatacaacactgtcctgaagagcttatgcgacaatggcatgagtcagcgggcgctcgacctgctccagaggatggcgaaagaaggaggtgtctgctctctcaatctggtggcatataacacggtcatccatggcttctttaaggaaggtgaaacaggcaaggcatgcagtctgttccatgaaatgatgcagcaaggtgttgtgcccaatgtgtggacgtatacctcgattattgatgcattgtgcaaggccagagcaatggacaaggcagagctagtccttcgtcagatggttgctaaaggtgctcaacctgatatagtgacatatacttgcatgatcaatggatatgccacatctgggcggttgaaagaggctgctaaaatgttcagagaaatgaaaagccggggtcttacaccaaatattgttacctgcggctcgttaatgacttacctttgcaagcatggaagaagcaaagaagctagagaaatatttgattccatgactgccaaaggccacagagctaatgtcgtctcgtactgtattttgcttcatgggtatgccaatgaaggatgctttgctgatatgattgatctctttaattcaatgaaaagcaacggtattgcagccgactgccgtgttttcaacatattaattaatggatatgctaaacgtggaaagatggatgaagctatgctcatatttacggaaatgtgggaaaaaggagtgagtcccgatgtggttacctattccactgtaatagctgcactttccaggatgggtagattgaccgatgccatggacaaatttaatcagatgatttccatgggggttcaaccgaacacagctgtttatcactccctaattcagggctcttgtatgcatggtgatttgattaaagccaaggagctggtttctgaaatgatgaacaaaggtattcctcgtcctagcattgcgttcttcggttcaataataaacaggttatgcaaagatggaagggttatggatgcacatgatatctttgacttggttatagacataggcgagaggcctagtgtcattacatttaattcactgattgacggatattgcttagtcgggaagatggataaagcatttaaaatactcgatgccatggaagtagttggtgttgagtctgatgttattacatatagtacacttcttgatggctattttaaaaatggaaggatcaatgatggtttgactctgtttagagaaatgccgcataagggaattaaacctgacactgtgacatatggcatcatgttggatgggttgtttcgtgctggcagaactgttgctgtaaggacagtgttccatgagatgatcgaaagtggaataacagtggacatccccacatacaatatagttcttggaggactttgtagaaataactgcacagatgaagcaatcgccctgttccagaaattaggtgcaatgagtgtgaagtccaatattgcaatactcaataccatgatcgatggaatgtacaaggttcggagaagagaagaagccaatgatttatttgctacaatatcagccagtggattggtgcccaatgaatctacttatgcagtaatgataataaatcttctaaaagatggagcagtggaagaagcagacaatatgttttcatcaatggagaaaactggtatagtccccagctcccgtctgttaaatcacatcatcagaatgttgttggaaataggtgagattgccaaggccggaaattacttgtctaaagttgatgggaagagcatctcacttgaagcgtcaacaacttcattgatgttgtctttcttttcgaagaaaggcaaatatcgggaggacatgaaattgctgcctgcaaagtttcaaatttttgatggatttggt

SEQ ID NO: 1763 - DNA, 2475 bp, Triticum aestivum; identical to SEQ ID NO: 1762

SEQ ID NO: 1764 - DNA, 2475 bp, Triticum aestivum; identical to SEQ ID NO: 1762

SEQ ID NO: 1765 - DNA, 2475 bp, Triticum aestivum; identical to SEQ ID NO: 1761

SEQ ID NO: 1766 - DNA, 2475 bp, Triticum aestivum; identical to SEQ ID NO: 1762

SEQ ID NO: 1767 - DNA, 2475 bp, Triticum aestivum
atgccccgctcccgcctccgtcgctacgcctccaccatgccgatgtccagcctccgtcccctccaccgcagctcctcctccaccacgtcgcctgcacgcgcctggtccccccatgccgccttcgccgcggccacggagcgtgtccgcgccgggacgctcaggccggaagacgcacacaccctgttcgacgaattgcttcggcaggccaccccggtccccgaccgctccctcaacggcttccttgccgccctcgcccatgcgcccgcctccggcaactgcatcagagatggccccgccctcgcagttgctctcttcaaccgtgtgtgcagagaggaagccggcccgcgggtggcggtgctcacaggctgcacctacagcatcctcatggactgctgctgccgcgcccgtcgcccggacctagggcttgccttatttggccgcttcctcagggaaggcctgaagacagaccagatcgtcgccaacaccttcctcaagtgcctctgctacgcgaaacggacggatgaggcagtggacgtgctgcttcataggatgtccgagctcgggtgtgtgcctgatgccatctcatacaacactgtcctgaagagcttatgcgacaatggcatgagccagcgggggctcgaactgctccagatgattgcaaaagaaggaggtgtctgctctctcaatctggtggcatataacacggtcatctacggcttctttaaggaaggtgaaacaggcaaggcacgcaatctattccatgaaatgatgcagcaaggtgttgagcccgatgtggtgacttacaacttgatcattgatgcgttgtgcaaggccagagcaatggacaaggcagaagtagtccttcagcagatgatcagtaaaggtgctcaacctgatacagtgacatataattgcatgatcaatggatatgccacatctgggcggttgaaagagtctgctaaactgttcagagaaatgaaaagccggggtcttacaccaaataatgttacttgcaactccttcctgtcctccctttgcaagcatggaagaagcaaagaagctagagaaatatttgattccatgactgccaaaggccgcagagctaatgtcgtctcatactctattttgcttcatgggtatgccaatgaaggatgctttgctgatatgattgatctctttaattcaatgaaaagcaacggtattgcagctgactgccgtgtttttaccatattaattgatgcctatgctaaacgtggaatgatggatgatgcaatgcacatatttacggaaatgcaacaacaaggtgtgagtccaaatgttgtcacatattcaactgtaatatcagcactttctagaatgggtaggttgaccgattctatggaaaaatttaatcagatggttgccttgggagtacagccggatagagctatttatcggtccctaattcagggcttttgtatgcatggtggtttggttaaagctaaggagttggtttctcaaatgataaacaaaggtattcctcgtcctagcattgagttcttcaattcagtaataaacagtatgtgcaaggaaggaagggttatggatgcacatgatatctttgacttggttatagacattggtgagaggcctgatgacattacatttaattcactgattgacggatattgcttagtcgggaagatggataaagcatttaaaatactcgatgccatggaagtagttggtgttgagcctgatgttattacatataatacacttcttgatggctattttaaaaatggaaggatcaatgatggtttggctctgtttagagaaatgccgcataagagaattaaacctgacattgtgacatatggcatcatgttggatgggttgtttcgtgctggcagaactgtttctgcaaggacaatgttccatgagatgatcgaaagtggaataacagtgaacatcttcacatacaatatagttcttggaggactttgtagaaataactgcacagatgaagcaatcgccctgttccagaaattaggtgcaatgagtgtgaagttcaatattgcaacacttaataccatgatcgatggaatgtacaaggttcggagaagagaagaagccaatgatttatttgctacaatatcagccagtggattggtgcccaatgaatctacttatgcagtaatgataataaatcttctaaaagatggagcagtggaagaagcaaacaatatgttttcctcaatggagaaaactggtatagtccccagctcccgtctgttaaatcgcatcatcagaatgttgttggaaataggtgagattgccaaggccggaaattacttgtctaaagttgatgggaagagcatctcacttgaagcgtcaacaacttcattgatgttgtctttcttttcgaagaaaggcaaatatcgggaggacatgaaattgctgcctgcaaagtttcaattttttgatggatttggt

SEQ ID NO: 1768 - DNA, 2442 bp, Triticum aestivum
atgtcgcgcatccgcctccgccgccgccgccgccaccgcctcccctcttccacctcgcgaccctcaccctcgtggtctccccacgccgcctgtgcggcggccacggagcgcgtccgcgccggaacgctcagcccgcaagacgcacaccacctgttcgacgaattgttaaggcaggccaccccggtccctgagcgctccctgaacggattcctcgccgccctcagccgtgctacgccctccaaagcctgcagagacggccccgccctcgtcctctccctcttcaaccgtgtctgccgagaagaagccggcggcatgcgggtggcgccgcccaccatcttcacctacggcgtcctcatgaactgctgctgccgcacccgtcgtccggaacttgggctcgccttcttcggccgcctcctaaggacgggcctgaaggcagacaagaccatcgccaacactgtcctcaagtgcctgtgctgcgctaaacggacagacgatgctgtgaaagtgctgcgtcgtaggatgagcgagctggggtgtgtgcctgatgccttctcatacgccattgtcctgaagggcttatgtgatgataacaggagccagcaggcgctcgacctgctccggatgatggcgaaagaaggtgtgtgctcccctgacgtggtcacatataacacggtcatccacggcttctttaaggaaggaaaaataggcaaggcctgcaatctattccatgaaatgacgaagcaagggtttgtgcctaatgtggtgacatataactcggttatcagtgcattgtgcaaggcccgagcaatggacaatgcagagttgttccttcgggagatggttgataacggcgttcaaccgaataaagtgacatatactagcatgatccatggatattccactttgggccagtggaaagaggcgactaaactgttcagagaaatgacaagcagtggtcttataccagatattgtcacttggaattcgttcattgactccctttgcaagcatggaagaagcaaagaagctgcagaaaattttcattccatgtctgcaaagggccacaagcctgatatcatctcctacgccactcttcttcatgggtatgccaatgaaggaagctttcctgatatgatgagtttctttaagtcaatggaaggcgacggtattgtagccaactgccaagttttcaacatattaattgatgcatatgctaaacgaggaatgatggacgaagctatgctcatatttactgaaatgccaggacaaggagtcaatccaaatgtagtcacctattcaactgtgatagcttcactttgcagaatgggtaggctggctgatgcaatgaataagttcagtgagatgattggtacgggagtacaaccgaacacagttgtttatcactccctagttcagggcttatgtacacatggtgatttggtgaaagcgaaggagttgatttctgaaatgatgaataaaggtattcctcgtccaaacattgcattcttcagttcaatagtacacagtctatgcaaagaaggaagggttatggatgcacaccatatctttgacttggttaaagacataggggagagatctgacatcattatgtttaatacgctgattgatggatattgcctaattggtgagatgggcaaagcagtcagtgtactagatgtcatgatatcagccggcattgagcctgatatctttacatataatacacttgtcaatggttattttaagagtggaaggattgatgatgggttgaatctgttcagagaaatgtcacataagaaaattaaaccttcaactgttacatataacatcatactggatggattatttcgtgctgggagaaccgttgctgccaagaaaatgctccatgagatgatcggatgtggaacaactgtgagcttgtccacatacaacataattcttagaggactttgtagaaataattgcaccgacgaagcaatcgccatgttccagaaattacgcacaattaatgtaaagttcaatatcacaacactcaataccatgattaattcaatgtacactgttcagagaagagaagaagctaaagatttgtttgctgcaatatcagacagcgggttggtgcccaatgtctctacatacggcataatgatacgaaatcttctaaaagaaggatcagtgaaagaagctgacaatatgttcttatcaatggagaagagtggttgtgctccttgctcccgtcttttaaatgataccattagaacgttattggagaagggggagatagtcaaggccggaaattatatgtctaaagttgatggcaagagcatctcacttgaagcttcaactagttcattgttgttgtctctgttttctgggaaaggtaaatatcgtgaacaaatacaattgctccctgtaaaataccaattcttcggtggagttagt

SEQ ID NO: 1769 - DNA, 2442 bp, Triticum aestivum; identical to SEQ ID NO: 1768

SEQ ID NO: 1770 - DNA, 2442 bp, Triticum aestivum
atgtcgcgcatccgcctccgccgccgccgccgccaccgcctcccctcttccacctcgcgaccctcacccacgttgtctccccacgccgcctgtgcggcggccacggagcgcgtccgcgccggaacgctcagcccgcaagacgcacaccacctgttcgacgaattgttaaggcaggccaccccggtccccgagcgctccctgaacggattcctcgccgccctcagccgtgctacgccctccaaagcctgcagagacggccccgccctcgtcctctccctcttcaaccgtgtctgccgagaagaagccggcggcatgcgggtggcgccgcccaccatcttcacctacggcgtcctcatgaactgctgctgccgcacccgtcgtccggaacttgggctcgccttcttcggccgcctcctaaggacgggcctgaaggcagacaagaccatcgccaacactgtcctcaagtgcctgtgctgcgctaaacggacagacgacgctgtgaaagtgctgcgtcgtaggatgagcgagctggggtgtgtgcctgatgccttctcatacgccattgtcctgaagggcttatgtgatgataacaggagccagcaggcgctcgacctgctccggatgatggcgaaagaaggtgtgtgctcccctgacgtggtcacatataacacggtcatccacggcttctttaaggaaggaaaaataggcaaggcctgcaatctattccatgaaatgacgaagcaagggtttgtgcctaatgtggtgacatataactcggttatcaatgcattgtgcaaggcccgagcaatggacaatgcagagttgttccttcagcagatggttgatgacggcgttcaaccgaataaagtgacatatactagcatgatccatggatattccactttgggccagtggaaagaggcgactaaactgttcagagaaatgacaagcagtggtcttataccagatattgtcacttggaactcgttcattgactccctttgcaagcatggaagaagcaaagaggctgcagaaatttttcattccatgtctgcaaagggccacaagcctgatatcatctcctacgccactcttcttcatgggtatgccaatgaaggaagctttcctgatatgatgagtctctttaagtcaatggaaggcgacggtattgtagccaactgccaagttttcaacatattaattgatgcatatgctaaacgaggaatgatggacgaagctatgctcatatttactgaaatgccaggacaaggagtcaatccaaatgtagtcacctattcaactgtgatagcttcactttgcagaatgggtaggctggctgatgcaatgaataagttcagtgagatgattggtacgggagtacaaccgaacacagttgtttatcactccctagttcagggcttatgtacacatggtgatttggtgaaagcgaaggagttgatttctgaaatgatgaataaaggtattcctcgtccaaacattgcattcttcagttcaatagtacacagtctatgcaaagaaggaagggttatggatgcacaccatatctttgacttggttaaagacataggggagagatctgacatcattatgtttaatacgctgattgatggatattgcctaatcggtgagatgggcaaagcactcagagtacttgatgccatgatatcagctggcattgagcctgatatctttacatataatacacttgtcaatggttattttaagagtggaaggatcaatgatgggttgagtctgttcagagaaatgtcacacaaggaaattaaacctacaactgttacatataacatcatactggatggattatttcgtgctgggagaactgttgctgccaagaaaatgctccatgagatgaccggatgtggaacaactgtgagcttgtccacatacaacataattcttagaggactttgtagaaataattgcaccgacgaagcaatcgccatgttccagaaattacacacaatgaatgtaaagttcaatatcacaacactcaataccatgattaattcaatgtacactgttcagagaagagaagaagctaaagatttgtttgctgcaatatcagacagtgggttggtgcccaatgcctctacatacgacataatgatacgaaatcttctaaaagaaggatcagtggaagaagctgacaatatgttcttatcaatggagaagagtggttgtgctccttgctctcgtcttttaaatgataccattagaacgttattggagaagggggagatagtcaaggccggaaattatatgtctaaagttgatggcaagagcatctcacttgaagcttcaactagttcattgttgttgtctctgttttctgggaaaggtaaatatcgtgaacaaatacaattgctccctgtaaaataccaattcttcggtggagttagt

SEQ ID NO: 1771 - DNA, 2442 bp, Triticum aestivum
atgtcgcgcatccgcctccgccgccgccgccgccaccgcctcccctcttccacctcgcgaccctcaccctcgtggtctccccacgccgcctgtgcggcggccacggagcgcgtccgcgccggaacgctcagcccgcaagacgcacaccacctgttcgacgaattgttaaggcaggccaccccggtccctgagcgctccctgaacggattcctcgccgccctcagccgtgctacgccctccaaagcctgcagagacggccccgccctcgtcctctccctcttcaaccgtgtctgccgagaagaagccggcggcatgcgggtggcgccgcccaccatcttcacctacggcgtcctcatgaactgctgctgccgcacccgtcgtccggaacttgggctcgccttcttcggccgcctcctaaggacgggcctgaaggcagacaagaccatcgccaacactgtcctcaagtgcctgtgctgcgctaaacggacagacgatgctgtgaaagtgctgcgtcgtaggatgagcgagctggggtgtgtgcctgatgccttctcatacgccattgtcctgaagggcttatgtgatgataacaggagccagcaggcgctcgacctgctccggatgatggcgaaagaaggtgtgtgctcccctgacgtggtcacatataacacggtcatccacggcttctttaaggaaggaaaaataggcaaggcctgcaatctattccatgaaatgacgaagcaagggtttgtgcctaatgtggtgacatataactcggttatcagtgcattgtgcaaggcccgagcaatggacaatgcagagttgttccttcgggagatggttgataacggcgttcaaccgaataaagtgacatatactagcatgatccatggatattccactttgggccagtggaaagaggcgactaaactgttcagagaaatgacaagcagtggtcttataccagatattgtcacttggaattcgttcattgactccctttgcaagcatggaagaagcaaagaagctgcagaaaattttcattccatgtctgcaaagggccacaagcctgatatcatctcctacgccactcttcttcatgggtatgccaatgaaggaagctttcctgatatgattagtttctttaagtcaatggaaggcgacggtattgtagccaactgccaagttttcaacatattaattgatgcatatgctaaacgaggaatgatggacgaagctatgctcatatttactgaaatgccaggacaaggagtcaatccaaatgtagtcacctattcaactgtgatagcttcactttgcagaatgggtaggctggctgatgcaatgaataagttcagtgagatgattggtacgggagtacaaccgaacacagttgtttatcactccctagttcagggcttatgtacacatggtgatttggtgaaagcgaaggagttgatttctgaaatgatgaataaaggtattcctcgtccaaacattgcattcttcagttcaatagtacacagtctatgcaaagaaggaagggttatggatgcacaccatatctttgacttggttaaagacataggggagagatctgacatcattatgtttaatacgctgattgatggatattgcctaattggtgagatgggcaaagcagtcagtgtactagatgtcatgatatcagccggcattgagcctgatatctttacatataatacacttgtcaatggttattttaagagtggaaggattgatgatgggttgaatctgttcagagaaatgtcacataagaaaattaaaccttcaactgttacatataacatcatactggatggattatttcgtgctgggagaaccgttgctgccaagaaaatgctccatgagatgatcggatgtggaacaactgtgagcttgtccacatacaacataattcttagaggactttgtagaaataattgcaccgacgaagcaatcgccatgttccagaaattacgcacaattaatgtaaagttcaatatcacaacactcaataccatgattaattcaatgtacactgttcagagaagagaagaagctaaagatttgtttgctgcaatatcagacagcgggttggtgcccaatgtctctacatacggcataatgatacgaaatcttctaaaagaaggatcagtgaaagaagctgacaatatgttcttatcaatggagaagagtggttgtgctccttgctcccgtcttttaaatgataccattagaacgttattggagaagggggagatagtcaaggccggaaattatatgtctaaagttgatggcaagagcatctcacttgaagcttcaactagttcattgttgttgtctctgttttctgggaaaggtaaatatcgtgaacaaatacaattgctccctgtaaaataccaattcttcggtggagttagt

SEQ ID NO: 1772 - DNA, 2442 bp, Triticum aestivum; identical to SEQ ID NO: 1768

SEQ ID NO: 1773 - DNA, 2442 bp, Triticum aestivum; identical to SEQ ID NO: 1768

SEQ ID NO: 1774 - DNA, 2442 bp, Triticum aestivum; identical to SEQ ID NO: 1768

SEQ ID NO: 1775 - DNA, 2436 bp, Triticum aestivum
atgtccaacctccgcctcctccgccgcagctcctcctccacctccacccccacctcgtggtcctcgcgttcatggtctccccacgcagcctttgccgcggccacagagcgtgtccgcgccgggacgctgaaccaagacgacgcacaccacctgtttgacgaattgctgcggcaggccaacccggtccccgggcgctccctgaacggcttcctcgccgccctcgcacgtgctacgtcctctgccgcctgcatcagagatggtcccaccctcgccatcgccctcttcaaccgcctgtgccgagaacaagccggcctgcgggtagcgcctctcacgatccacacctacggcatcctcatggactgctgctgtcgtgcaagtcgcccggagctagggcttgccttattcggccgctttctcaggacgggcctcaagacaaacgagatcgtcgccagcaccttcctcaagtgcctctgctacgcaaaacggacggatgaggctgtgaatgtgctgcttcataggatgtccgagctcggctgtgtgcctaatgccatctcatactccattgttctgaagagcttatgcgacaatagcatgagtctgcgggcgctcgacctgctccagatgatggcgaaagaaggaggtgcctgctcccccaacgtggtggcatatagcacggtcatccatggcttctttaaggaaagcgaaacaggcaaggcatgcaatctgttccatgaaatgatgcagcaaggtgttgaacccagtgtgtggacatatagttcaatcattgatgcattgtgcaaggccagagcaatggacaaggcagagctagtgcttcagcagatggttaacaaaggtgttcaacccaataatgtcacatataattgcatgatccatggatattccacatctgggcagtggaaagaggctgctaaattgctcagagaaatgaaaagccggggccttataccagatattgtcacttgcaactcgttcctggcctccctttgcaagcatgggagaagcaaggaagctgcagaatttcttgattccatgactgccaagggccacaaaccagatatcgtatcataccgtattttgcttcatgggtatggtactgaaggatgcttcgctgatatgattgatgtcttttattcaatggaaagcaacggtattgcagctgactgccatgttttcaacatattaattaatggatatgcaaaacgtggaatgacagaagaagctatgctgatatttactgaaatgcagggacagggagtgagtccagatgtagtcacctattccattgtaatagccgcactttccagaatgggtaggctgaccgatgctatcgagaaattcaatgagatgactgccttggaagtacagccggacacaactgtttatcactcactgattcagggttgttgcatagacggttatttggttaaagctaaggagctgatgtttgaaatgatgaacggtggtattcctcggcctaacattgtgttcttcagttcagtaataaacagtctgtgcaaagaaggaagggttatggatgcacatgatgtcttagacttggttataggcataggtgagaggcctaatgtcattacatttaattcactgattgacggatattgcttagtcggcaacatggataaagcattcaaaatacttgatgtcatggaatcagttggtgttgagcctaatgttgttacttatagtgcacttcttgatggctattctaaaaacagaaggattgatgatgctttgactttgtttagagaaatgccgcgtaagagaattaaacctgacactgttacatatggcatcatgttggatgggttgtttcgtgctgggagaactgtcgctgcaatggaaatgttccatgagatgactgagagtggaacaacagtggacattttcatatacaatataatacttggaggtctttgtagaaataattgtgtagatgaagcgattgcactgttccagaaattgcgagcaatgaatgtgaagttcaatattgaaatactcaataccatgattaatgcaatgtacaaggttcaaagaaaggaagaagcaaaggaattgtttgctacaatatcagccaatgggttggtgcccaatgaatctacttatgcagtaatgataagaaatcttctaaaaggcggagcagtggaagatgctgacaatatgttttcatcaatggacaacagtggcatcgttcccagttcccgtcttataaatgatatcatcagaatgttgttgaaaaaaggtgagatagccaaggctggcaattatttgtctaaagttgacgggaagagtatctcacttgaagcttcaactacctcattgttgttgtctcggaaagggaaacatcaggtggatattaagttgctccctgcaaagtatcaattttttgatggatttggt

SEQ ID NO: 1776 - DNA, 2436 bp, Triticum aestivum; identical to SEQ ID NO: 1775

SEQ ID NO: 1777 - DNA, 2436 bp, Triticum aestivum; identical to SEQ ID NO: 1775

SEQ ID NO: 1778 - DNA, 2322 bp, Triticum aestivum
atgccaaccgcccgcctgtcctccgtctccgcctcctccttcaaggcttcttcacgaaaaccacgagcccccctcgccgccttggctgctgccacggagcgtgtgcgcgccggaacactaagccaggaggacgcgcaccacctgttcgacgaattgctaggccaagccaccgccgtcccggaacgcgggctgaacaactttcttgccgcactagcccgtgcatcgccctcggctacctgcagcgatggccccggccttgccgtcaccctcttcaaccgcatgtcccttggcgctggtgcacgggtggcgtcgcccacactctgtacctattccatcctcatggactgctgctgccgtgcaggccgcccagacttggtggttgccttcttcggccgcctcctcaggttggggctgcgcttgaatgtcatctccttcaacaacctcctcaaggggctttgccaggctaagcgctcaaatgaggcattggatctgctgctccaccggatgcccgaactggactgtgcgcctgatgtcttctcgttcaacatagtaatcaacggctgctttagagaaggtgaagtagacaaagcatgcaatctcttccatgagatgccccaactgggagttcaacctgatgtggtgacctacaactcaattatcatcgcactaagcagggccggagcaatgggtaaggcagaagtggtccttcggcaaatggttgataaaggcattggacccgatgtcatgacatataacagtctgatccatggatattctactttgggtcagtggaaggcagcagttagggtattcaaagagatggtaagtgttggtgttctaccaaatgctgtcacgttgaactcatttatggattcactttgcaagcatagaaggacaaaggaagctagagatatttttgactccatggctgcaaagggccacaaacctaatattgcctcctactctactatgcttaatgggtatgcgaaacaaggatgcttcgatgatatgactggtctcttcaattccatggtacagaatggtattgtacctaacaaccatgttttcaacatactgatcagagcatattctacacgtggactgatggacgaggctatgcacatgttcgaagtaatgaagcaacaaggagtaaacccagatgtagttgactatctagtagtaatagattcactttgcaaaatgggcaggatggatgctgctatggacaaatttaatcagatggtcaatcaaggagtttcacctgacatagttgtttaccaatgcctggttctgggttcttgctctaatggtgattttgtgaaagccaaagaattgatttctgaagcagttaatcgaggtctgtgttctaacagtgtgttcttctatcctgtaataaacaacctgagcaaagaaggaaatgtaaaggatgcacaagatatgtttgacttcattgtaggtattggtcatcagcctgatgttattatgtacaattcactgatggatggatattgccttgttggcaaggtggaggaagcaatgacagtgcttgatgctatgaagtccgctggcctccaacctgatgctattacgtatgctatacttcttaatggctactgtaaaattggaaggatcgacgatggattgagtctttttagggaaatctcactcagcagggttaagcccacgactattatgtacaacattatacttgatgggctgttttgctgtgggagaacagtttttgcaaaggaagaattcgatacaatgattgaaagtggcataccagtgggcattgacacatgcaccatagttcttagtggactttgcaaaaataattgcactgatgaagcaatagagctgttcaagaagttatgtgcaatgaatgtgaagtttgatgtcataattctcactaccatgatttctgcaatgtttaagactaggagagttgaagaagccaaggatttgtttgctactatatcaaccatagggttggtgccttctgtcgtgacttacagtgtaatgatgacgaatttcataaaagaagggtcgctggcagaggctgatgatatgtttttagcaatggagaaggctggctgtgctcctgactccagactgctaaatcacgtggtcagagtgttgctggagaaaggtgcagttgtaaaggctgcaacttatctcggtaaacttgatggaaaacagctgtcacttgaagcttcgacggtttcgttaattgtatctctcttctcaaggaaagggaaattaagggagcatgtaaaattgcttccggtaaagtaccagcctcctgagagttcgactgacaat

SEQ ID NO: 1779 - DNA, 2322 bp, Triticum aestivum; identical to SEQ ID NO: 1778

SEQ ID NO: 1780 - DNA, 2322 bp, Triticum aestivum; identical to SEQ ID NO: 1778

SEQ ID NO: 1781 - DNA, 2469 bp, Triticum aestivum
atgtcccgcctccgctccgcctccaccgcgccgatgccccgcctccgcctcctcagctgccgctcctactccatctccaccttgccgccgtcacgctcatggtctccccacgccgcctttgccgctgccacagagcgcgtcagcgctgggacgctcaccccggaggacgcacaccacctgttcgacgaattgctgcggcagtccactccggtccccgctcgatccctgaacggcttccttacggccctggcccgtgcgcgggacaccgacgcctgcagagacggccccgccctcgccctcgccctcttcaaccgcacccgccgagaagaggccggctcccgggtggtgtcgcccacaatcttcacctacggcatcctcatgaactgctgctgccacacgcttcgtccggatcttgggcttgccttctttgggcgcgtcctcaggatgggcctgaagacaaatgtggtcgtcgccaccacggtcctcaagtgcctctgcggcgccaaacggacagatgaggctgtgaacatcctgctacatcggatgtccgagctcgggtgtgtgcctgatgacttctcatattccattgttctgaagagcttatgtgatgatggcaggagccagcgagcacttgacctgctccagatgtgggagaaagaacgaggtgtctgctcccccaacgtagtggcatataacatagtcatccatggcttctttaaggaaggtgaagtaagcaaggcatgtgacctgttccatgcaatggtgcagcgaggggttgtgcctaatgtgatgacatataccttgactattgatgcgctgtgcaaggccagagctatggacaaagcaaagttgttcctccggcagatgattgataaaggtgttcgaccgaacaatgtgacatataatgtcatgatccatggatattccactctgggccagtggaaagaagcgggtaaagtgttcagagaaatgtcaagacagggtctcataccagatatcgttacttggacctcgttcatggcctctctctgcaagcatggaagaaccaaagaagctgccaatttttttgattccatgactgccaagggccacaagcctgatttggtcacgtatcatgttctgctccatgggtatggaaccgaaggatgctttgctgatatgattaatctcgttaattcgatggcaaccaaaggtattgttcccgatcgtcaggttttcaacattttaatcgatgcacatgctaaacatggaatgatggatgaagctatgcacatatttactggaatgcagggacaaggagtgtgtccagatgtatggacctattcaactataatatctgcactttgcagaatgggtaggctggctgatggtatggataacttcagccagatgattggtaagggagtagaaccgaacacagttgtttatcactccctaattcagggtttctctacacatggtgatttgaggaaagcgaaggagttggtttatgaaatgagaaacaaaggtattccttgtccaaacattgcattcttcacttctataatggacagtctatgcaaagaaggaagggttatggatgcacatgatatcttcaacttggttacagacataggtgagaaacctaacgtcattacgtttaatacgctgattgatggacattgcttagtcggtgagatggagaaagcatttggagtacttgattccatggtatcagctggcattgaggctgatgtttttacatataacacacttgcttatggctattgtagatgtggaaggattgatgatgggttgattctattcagagaaatgttgcgtaagaaacctaaacccacaacaattacatataacataatactggatgggttatttcgtgctgggagaacagttgctgcaaagaaaatgttccatgagatgatcgaagggggaataacagtgagcatgtccacgtacagtataatccttggaggactttgtaggaataattgtgctgaagaagcgatcaccctgtttcagaaattaggagcaatgaatgtgaaattggatattagaatactcaataccatgatcaatgcaatgttcaaggttcggagaagagaggaagctaacagtttgtttgctgcaatatcagccagtggaatggcacctaatgcttctacctacggcctaatgatagggaatcttctaaaagaaggatcagtgcaagaagccgaaaatatgttctcattaatggagaagagtggttgtgctccaggctctcgtcttataaataatatcatcagaatattattggaaaaaggtgacattgtcaaggctggaaattatatgtctaaagttgatggcaagaccatctcacttgaagcttcaactacttcgttgttgatgtgtctcttttcaagtaaagggagatatcgggaacaaatcaatttgctccctggaaattaccaatttttcaatggagtcagt

SEQ ID NO: 1782 - DNA, 2316 bp, Triticum aestivum
atgccaaccgcccgcctgtcctccgtcttcgcctcctccttcaagtcttctttacggaagccacgagctcccgtcgccgctttggctgctgccacggagcgtgtgcgcgccagaacgctaagccagcaggacgcgcaccacctgttcgacgaattgctgagccaagccgccgccgtccccgaacgcgggctgaacaactttcttgccgcactagcccgtgctccgccctcatctgcctgcagcgatggccccggccttgccattgccctcttcaaccgcatgtcccaaggcgctggtgcacgggtggtgtcgcccacgctctgtacctattccatcctcatggactgctgctgccgcgcaggccgcccggacttggtggttgccttcttcggtcgcctcatcaggttggggttgcgcttggacgtcatcgccttcagcaatctcctcaaggggctttgcaaggccaagcgctcaaatgaggctttggatctgctgctccaccggatgcccgaactggactgtgcgcctgatgtcttctcctacagcattgtaatcaacggctgctttaaagaaggtgaagtagacaaagcgtgcaatctcttccatgagatgatccaactgggagttcaacctgatgtggccatctacacctcaattatcgatgcactaagcaagtgcggagccatggacaaggcagaagtggtccttcggcaaatggttgatcaaggcattggacccgatgtcatgacatatagcagtctgatccatggatattctactttgggtcagtggaaggcagcagttagggtactcaaagagatggtaagtgttggtgttcgaccagatgctgtcacgttgaactcatttatggattcactttgcaagcatagaaggacaaaggaagctagagatatttttgactccatggctgcaaagggccacaaacctaatattgtctcctacactattatgcttaatgggtatgttaaagaaggatgcttcgatgatatgactggtctcatcaattcgatgctacagaatggtattgtacctgatcaccatgttttcaacatactgatcaatgcatattctaaacgtgggctgatggatgaggctatgcacatgttcgaagtaatgaagcaacaaggagtaaacccagatgtagttgactatctagtagtaatggattcactttgcaaaatgggtaagatggctgctgctatggataaatttaatcagatgatcaatcaaggagtttcacctaacaaagctgtttaccaatgcctggttctgggttcttgctctcatggtgattttgtgaaagccaaggaattgatttctgaagcagttaatagaggtctctgttctaacagtgtgttcttctatcctgtaataaacgacctgtgcaaagaaggaaaggtgaaggaggcacaggatatgtttgacttcattgtaggtattggtcagcggcccgatgtgattatgtacaattcactgatggatggatattgccttgttggcaaggtggaggaagcactgagagtacttgatgctatgaagtctgctggcctccaacctgatgctattacgtatgctatacttcttaatggctactgtaaaattggcaggatcgccgatggattgagtcttttcagggaaatgtcactcagcggggttaagcccacgactattatgtacagcattatacttgatgggctgtttcgctccgggagaacagtttctgcaaaggaaaaattcaatacgatggttgaaagtggcttaccagtggacgttcgcacatacaacatagttcttcatggactttgtagaaacaattgcactggtgaagcaatagagttgttcaaaaaattatgtgcaacgaacttgaagattaatgtcataacattcaataccatgatttctgcaatgtttaaaactaggagaattggagaagccaaggatttgtttgctactatatcagccatcgggttggtgccttctgttgtgacttacagtgtaatgacgacgaatttcataaaagaagggttgctggcggaggctgatgatatgtttttagcaatggagaaggctggctgtgctcctgactccagactgctaaatcacgtggtcagcgtgttgctggagaatggtgcagttgtaaaggctgcaacttatctcgctaaacttgatgcaaaacagctttcacttgaagcttcgacagtttcgttaattgtatctctcttctcaaggaaagggaaattaagggagcatgtaaagttgcttccggtaaagtaccagcctcctgagatgttgggc

SEQ ID NO: 1783 - DNA, 2316 bp, Triticum aestivum; identical to SEQ ID NO: 1782

SEQ ID NO: 1784 - DNA, 2316 bp, Triticum aestivum
atgccaaccgcccgcctgtcctccgtcttcgcctcctccttcaagtcttctttacggaagccacgagctcccgtcgccgctttggctgctgccacggagcgtgtgcgcgccagaacgctaagccagcaggacgcgcaccacctgttcgacgaattgctgagccaagccgccgccgtccccgaacgcgggctgaacaactttcttgccgcactagcccgtgctccgccctcatctgcctgcagcgatggccccggccttgccattgccctcttcaaccgcatgtcccaaggcgctggtgcacgggtggtgtcgcccacgctctgtacctattccatcctcatggactgctgctgccgcgcaggccgcccggacttggtggttgccttcttcggtcgcctcatcaggttggggttgcgcttggacgtcatcgccttcagcaatctcctcaaggggctttgcaaggccaagcgctcaaatgaggctttggatctgctgctccaccggatgcccgaactggactgtgcgcctgatgtcttctcctacagcattgtaatcaacggctgctttaaagaaggtgaagtagacaaagcgtgcaatctcttccatgagatgatccaactgggagttcaacctgatgtggccatctacacctcaattatcgatgcactaagcaagtgcggagccatggacaaggcagaagtggtccttcggcaaatggttgatcaaggcattggacccgatgtcatgacatatagcagtctgatccatggatattctactttgggtcagtggaaggcagcagttagggtactcaaagagatggtaagtgttggtgttcgaccagatgctgtcacgttgaactcatttatggattcactttgcaagcatagaaggacaaaggaagctagagatatttttgactccatggctgcaaagggccacaaacctaatattgtctcctacactattatgcttaatgggtatgttaaagaaggatgcttcgatgatatgactggtctcatcaattcgatgctacagaatggtattgtacctgatcaccatgttttcaacatactgatcaatgcatattctaaacgtgggctgatggatgaggctatgcacatgttcgaagtaatgaagcaacaaggagtaaacccagatgtagttgactatctagtagtaatggattcactttgcaaaatgggtaagatggctgctgctatggataaatttaatcagatgatcaatcaaggagtttcacctaacaaagctgtttaccaatgcctggttctgggttcttgctctcatggtgattttgtgaaagccaaggaattgatttctgaagcagttaatagaggtctctgttctaacagtgtgttcttctatcctgtaataaacgacctgtgcaaagaaggaaaggtgaaggaggcacaggatatgtttgacttcattgtaggtattggtcagcggcccgatgtgattatgtacaattcactgatggatggatattgccttgttggcaaggtggaggaagcactgagagtacttgatgctatgaagtctgctggcctccaacctgatgctattacgtatgctatacttcttaatggctactgtaaaattggcaggatcgccgatggattgagtcttttcagggaaatgtcactcagcggggttaagcccacgactattatgtacagcattatacttgatgggctgtttcgctccgggagaacagtttctgcaaaggaaaaattcaatacgatggttgaaagtggcttaccagtggacgttcgcacatacaacatagttcttcatggactttgtagaaacaattgcactggtgaagcaatagagttgttcaaaaaattatgtgcaacgaacgtgaagattaatgtcataacattcaataccatgatttctgcaatgtttaaaactaggagaattggagaagccaaggatttgtttgctactatatcagccatcgggttggtgccttctgttgtgacttacagtgtaatgacgacgaatttcataaaagaagggttgctggcggaggctgatgatatgtttttagcaatggagaaggctggctgtgctcccaactccaggctgctaaatcacgtggtcagagtgttgctggagaatggtgcagttgtaaaggctgcaacttatctcgctaaacttgatgcaaaacagctttcacttgaagcttcgacagtttcgttaattgtatctctcttctcaaggaaagggaaattaagggagcatgtaaagttgcttccggtaaagtaccagcctcctgagatgttggac

SEQ ID NO: 1785 - DNA, 2316 bp, Triticum aestivum; identical to SEQ ID NO: 1782

SEQ ID NO: 1786 - DNA, 2316 bp, Triticum aestivum; identical to SEQ ID NO: 1784

SEQ ID NO: 1787 - DNA, 2316 bp, Triticum aestivum; identical to SEQ ID NO: 1782

SEQ ID NO: 1788 - DNA, 2316 bp, Triticum aestivum
atgccaaccgcccgcctgtcctccatcttcacctcctccttcaaggctccttcacgagagcgccgagctcccctcgccgccttggctgccgccacggagcgcgtccgcgccggaacgctaagtcggcaggatgcgcaccacctgttcgacgaattgctgagccaagccgcgacagtcccagtacgcacgctcaacaattttcttgccgccctcgcccgtgcaccaccctcagctgcctgtggcaatggcccggcccttgccgtcaccctcttcaacggcatgtcccgaggcgctggtgcacgggtggtgtcgcccacgtgctgtacctattccatcctcatggactgctgctgccgtgcaggccgcccggacctggtggttgccttcttcggccgcctccttaggttggggctgcgcttgaatgtcatctccttgagcaatctcctcaaggggctctgccaggccaagcgtacaaatgaggcggtggacttgctgctccaccggacacctgaactggactgtgtgcctgatgtcttctcgtacagcatagtaatcaacggctgtttaaaagaaggtgaagtagacaaagcgtgcaatctcttccatgagatgccccaactgggagttcaacctgatgtggtgacctacacctcaattatcgacgcactaagcaaatccggagccatggtaaaggcagaagtggtccttcggcgaatggttggccaaggcattggaccaaacgtcatgacatatactagcctgatccatggatattccgcttcgggtcagtggaaggcggcagttagagtattcaaggaaatggtaagtgttggtgttctaccaaatgctgtcactttgaactcatttatggattcactttgcaagcatagaaggacaaaggaagctagagttatttttgactccatggctgcaaagggccagaaacctgatattgtctcctactctattatgcttaacgggtatgtgaaagaaggatgctttgatgatatgaccggtctcttcaattcgatgctacagaacggtgttgtacctaaccaccatattttcaacatactgatcaatgcatatgctaaacgtggactgatggatgaggctatgcacatgtttgaagtaatgaggcaacaaggagtgaacccggatgtatttggctatcaaatcataatggattcattttgtaaaatgggtaggatggatgctgctctggacaaatttaatcagatggtcaatcaaggagtttcacctaacaaagctgtttaccaatgcctggttctgggttcttgctctcatggtgattttgtgaaagccaaggaattgatttgtgaagcagttaatagaggtctctgttctaacagtgtgttcttctatcctgtaataaacgacctgtgcaaagaaggaaaggtgaaggaggcacaggatatgtttgacttcattctaggtattggtcagcggcctgatgtgattatgtacaattcactgatggatgggtattgccttgttggcaaggtggaggaagcactgagagtacttgatgctatgaagtctgctggcctccaacctactgctgttacgtatgctatacttcttaatggctactgtaaaattggcaagatcgccgatggattgagtcttttcagggaaatgtcactcagcggggttaagcccacgactattatgtacaacattatacttgatgggctgtttcgctccgggagaacagtttctgcaaaggaaaaattcaatacgatggttgaaagtggcttaccagtggacgttcgcacatacaacatagttcttcatggactttgtagaaacaattgcactggtgaagcaatagagttgttcaaaaaattatgtgcaacgaacgtgaagattaatgtcataacattcaataccatgatttctgcaatgtttaaaactaggagaattggagaagccaaggatttgtttgctactatatcagccatcgggttggtgccttctgttgtgacttacagtgtaatgatgacgaatttcataaaagaagggttgctggcagaggctgatgatatgtttttagcaatggagaaggctggctgtgctcccaactccagactgctaaatcacgtggtcagagcgttgctggaaaaaggtgcagttgtaaaggctgcaacttatctcgctaaacttgatgctaaacagctgtcagttgaagcttcaacaatttcgttaatagtatctctcttctcaggggaagggaaactaagggagcacgtagagttgcttccggtaaagtaccagcctcctgagatgttggac

SEQ ID NO: 1789 - DNA, 2316 bp, Triticum aestivum; identical to SEQ ID NO: 1788

SEQ ID NO: 1790 - DNA, 2316 bp, Triticum aestivum; identical to SEQ ID NO: 1788

SEQ ID NO: 1791 - DNA, 2316 bp, Triticum aestivum; identical to SEQ ID NO: 1788

SEQ ID NO: 1792 - DNA, 2316 bp, Triticum aestivum; identical to SEQ ID NO: 1788

SEQ ID NO: 1793 - DNA, 2316 bp, Triticum aestivum; identical to SEQ ID NO: 1788

SEQ ID NO: 1794 - DNA, 2358 bp, Triticum aestivum
atgcctcgcttctcctccaccacgccgatgtcgccactccgccgccgcctccgcgcccgccactcctcctccacctcccattcctcacgcagctgggagccccacgccgccttcgccgccgccgcggagcgtgcgcgctctggcaacctcaccccggaggacgcacaccacctgttcgacgaattgctcaggcagggcaatcctgtccaggaccgccccttgaacaaacttctctccgccctcgcccgtgctccggcgtccgcggcctgcagaaacggccctgcactcgcggtcgccctcttcagccgcatatcccaaggtgcccgccgacgggtggcggatccaacggcctgcacctacggcatcctcatggactgctgctgccgcgcacaccgcctggatctgacgctggccttcttcggcggtctccttaagacgggacttaaggcaggcgtcattcaagtttgcactcttctcaagggcctctgccgcgcaaagcgggctgatgaggctctggacgtgctgcttcacaggatgcctgagctgggctgcacccccaacgtggtggcatataccacggtcatccacggcttctttaaggaaggccaagtaggcaaggcatgcaatctgttccatggaatggcgcagcagggcgttgcgcctaatttggtgacatataactcggttattgatgcgttgtgcaaggccaaagcaatggacaaggcagagtatttccttggtcagatggttgatgatggtgtcgtacctgataatgtgacatataatagcctcatccatggatattcctcttcaggccattggaaggaggcagttagggtattcaaagagatgacaagtcggagggttacagcagatgtccatacttacaacatgtttatgacctttctttgcaaacatggaagaagcaaagaagctgcaggaatttttgataccatggctctgaagggcctgaaacctgacaacgtttcatatgctattctccttcatgggtatgccaccgtaggatgcttagttgatatgattaatctcttcaattcaatggaaagagattgtattctacctgactgtcgtatcttcaacatactgattaatgcatatgctaaatctgggaagcttgataaggctatgcttatcttcaatgaaatgcagaaacaaggagtgagtccaaatgcagtcacatattcaactgtaatagatgcattttgcaaaaagggtcagttggacgatgctatgataaagtttaatcagatgattgatacaggagtacgacagggcacagctgtttatggttctctaatccagggtttttgtacacacggcgatttggtgaaagcaaaggaattgcttactgaaatgatgaacaaaggtatatctcctcctgatattaagttcttccattcaatcatgcagaaccttggcacggaaggaagggtaatagaagcacgggatgtccttggcttgatagcgcacataggtatgaggcctaatgtttgcacatttaatatactgatcggtggatattgcctagtcggcaagatggaggatgcctcaaaaatatttgatgatatgatgtcatatggcttagaaccttctaatattacgtatggtatacttattaatggctattgcaaaaacgaaaggattaacgatgggttgattctgttcaaagaaatgttgcgcaagggacttaaacctacaacttttaattacaacgtcatactggatggattatttctgactggacgaactgttgctgcaaaggaaaagtttgatgagatggttgaatctggagtaagtgtgtgcattgatacatattcgatagttcttggtggactttgtagaaataattgtagcggcgaagcaatcacgctattccagaaattaagcacaatggatgtgaaattcaatattacaattgtcaatataatgattgatgccttctacagggttcagcgaaaccaagaagccaaggatttgtttgctgcagtatcagccaatggtttggtagctaatgtctttacctacaccataatgatgaaaaatcttataaaagaagggtcagtggaagaagctgacaatctctttttatcaatggagaagagcggctgtactgctgattcttatatgttaaatcttatcgtcagaatgttactggaaaaaggagagctagtcaaggctgggaattatatgtctaaagttgatgcaatgagctactcacttgaagctgaaaccgtttcgctgcttatctctctcttttcggggaaagggaaatatagagaacacataggattgctccctgcaaagtatcggtttcgtgaagaagcagccacagttgtg

SEQ ID NO: 1795 - DNA, 1509 bp, Triticum aestivum
atgacaagtcggagggttacagcagatgtgcatacttacaacatgtttatgacctttctttgcaaacatggaagaagcaaagaagctgcaggaatttttgataccatggctatgaagggcctgaaacctgacaacgtttcatatgctattctccttcatgggtatgccaccgaaggatgcttagttgatatgattaatctcttcaattcaatggaaagagattgtattctacctgactgtcgtatcttcaacatactgattaaagcatatgctaaatctgggaagcttgataaggctatgcttatcttcaatgaaatgcagaaacaaggagcgagtccagatgcagtcacgtattcaactgtaatagatgcattttgcaaaaagggtcagttggacgatgctatgataaagtttaatcagatgattgatacaggagtaccacagggcacagctgtttatggttctctaatccagggtttttgtacacacggcgatttggtgaaagcaaaggaattggttactgaaatgatgaacaaaggtatacctcctcctgatattaagttcttccattcaatcatgcagaacctttgcacagaaggaagggtaatagaagcacgggatgtccttggcttgatagcgcacataggtatgaagcctaatgtttgcacatttaatatactgagcggtggatattgcctagtcggcaagatggaggatgcctcaaaaatatttgatgatatgatgtcatatggcttagaaccttctaatattacgtatggtatacttattaatggctattgcaaaaacgaaaggattaacgatgggttgattctgttcaaagaaatgttgtgcaagggacttaaacctacaacttttaattacaacgtcatactggatggattatttctaactggacgaactgttgctgcaaaggaaaagtttgatgagatggttgaatctggagtaagtgtgtgcattgatacatattcgatagttcttggtggactttgtagaaataattgtagcggcgaagcaatcatgctattccagaaattaagcacaatggatgtgaaattcaatattacaattgtcaatataatgattgatgccttctacagggttcagcgaaaccaagaagccaaggatttgtttgctgcagtatcagccaatggtttggtagctaatgtctttacctacaccataatgatgaaaaatcttataaaagaagggtcagtggaagaagctgacgatctctttttatcaatggagaagagcggctgtactgctgactcttatatgttaaatcttatcgtcagaatgttactggaaaaaggagagctagtcaaggctgggaattatatgtctaaagttgatgcaatgagctactcacttgaagctgaaaccgtttcgctgcttatctctctcttttcagggaaagggaaatatagagaacacataggattgctccctgcaaagtatcagtttcgtgaagaagcagccacaattgtg

SEQ ID NO: 1796 - DNA, 2358 bp, Triticum aestivum
atgcctcgcttctcctccaccacgccgatgtcgccactccgccgccgcctccgcgcccgccactcctcctccacctcccattcctcacgcagctgggagccccacgccgccttcgccgccgccgcggagcgtgcgcgctctggcaacctcaccccggaggacgcacaccacctgttcgacgaattgctcaggcagggcaatcctgtccaggaccgccccttgaacaaacttctctccgccctcgcccgtgctccggcgtccgcggcctgcagaaacggccctgcactcgcggtcgccctcttcagccgcatatcccaaggtgcccgccgacgggtggcggagccaacggcctgcacctacggcatcctcatggactgctgctgccgcgcacaccgcctggatctgacgctggccttcttcggcggtctccttaagacgggacttaaggcaggcgtcattcaagtttgcactcttctcaagggcctctgccgcgcaaagcgggctgatgaggctctcgacgtgctgcttcacaggatgcctgagctgggctgcacccccaacgtggtggcatataccacggtcatccacggcttctttaaggaaggccaagtaggcaaggcatgcaatctgttccatggaatggcgcagcagggcgttgcgcctaatttggtgacatataactcggttattgatgcgttgtgcaaggccaaagcaatggacaaggcagagtatttccttggtcagatggttgatgatggtgtcgtacctgataatgtgacatataatagcctcatccatggatattcctcttcaggccattggaaggaggcagttagggtattcaaagagatgacaagtcggagggttacagcagatgtccatacttacaacatgtttatgacctttctttgcaaacatggaagaagcaaagaagctgcaggaatttttgataccatggctctgaagggcctgaaacctgacaacgtttcatatgctattctccttcatgggtatgccaccgaaggatgcttagttgatatgattaatctcttcaattcaatggaaagagattgtattctacctgactgtcgtatcttcaacatactgattaatgcatatgctaaatctgggaagcttgataaggctatgcttatcttcaatgaaatgcagaaacaaggagtgagtccaaatgcagtcacatattcaactgtaatagatgcattttgcaaaaagggtcagttggacgatgctatgataaagtttaatcagatgattgatacaggagtacgacagggcacagctgtttatggttctctaatccagggtttttgtacacacggcgatttggtgaaagcaaaggaattgcttactgaaatgatgaacaaaggtttatctcctcctgatattaagttcttccattcaatcatgcagaaccttggcacggaaggaagggtaatagaagcgcgggatgtccttggcttgatagcgcacataggtatgaggcctaatgtttgcacatttaatatactgatcggtggatattgcctagtcggcaagatggaggatgcctcaaaaatatttgatgatatgatgtcatatggcttagaaccttctaatattacgtatggtatacttattaatggctattgcaaaaacgaaaggattaacgatgggttgattctgttcaaagaaatgttgcgcaagggacttaaacctacaacttttaattacaacgtcatactggatggattatttctgactggacgaactgttgctgcaaaggaaaagtttgatgagatggttgaatctggagtaagtgtgtgcattgatacatattcgatagttcttggtggactttgtagaaataattgtagcggcgaagcaatcacgctattccagaaattaagcacaatggatgtgaaattcaatattacaattgtcaatataatgattgatgccttctacagggttcagcgaaaccaagaagccaaggatttgtttgctgcagtatcagccaatggtttggtagctaatgtctttacctacaccataatgatgaaaaatcttataaaagaagggtcagtggaagaagctgacaatctctttttatcaatggagaagagcggctgtactgctgattcttatatgttaaatcttatcgtcagaatgttactggaaaaaggagagctagtccaggctgggaattatatgtctaaagttgatgcaatgagctactcacttgaagctgaaaccgtttcgctgcttatctctctcttttcggggaaagggaaatatagagaacacataggattgctccctgcaaagtatcggtttcgtgaagaagcagccacagttgtg

SEQ ID NO: 1797 - DNA, 2364 bp, Triticum aestivum
atgcctcgcttctcctccaccacgccgctgtcgccactccgcctccgccgccgcctccgcgcccgccactcctcctccacctcccattcctcacgcagctgggagccccacgccgccttcgccgccgccgcggagcgtgcgcgctctggcaacctcaccccggaggacgcacaccacctgttcgacgaattgctccggcagggcaatcctgtccaggaccgccccttgaacaaacttctctccgccctcgcccgtgctccggcgtccgcgacctgcagaaacggccctgcactcgcggtcgccctcttcagccgcatatcccaaggtgcccgccgacgtgtggcagagccaacggcctgcacctacggcatcctcatggactgctgctgccgcgcacaccgcctcgatctggtgttcgctttcttcggccgtctcctcaggacgggacttaaggcaggcgtcattcaagtttgcactcttctcaagggcctctgccgcgcaaagcgggctgatgaggctctcgacgtgctgcttcacaggatgcctgagctgggctgcactcccaacgtggtggcatataccacggtcatccacggcttctttaaggaaggccaagtaggcaaggcatgcaatctgttccatggaatggcgcagcagggcgttgcgcctaatttggtgacatataactcggttattgatgcgttgtgcaaggccaaagcaatggacaaggcagagtatttccttggtcagatggttgatgatggtgtcgtacctgataatgtgacatataatagcctcatccatggatattcctcttcaggccactggaaggaggcagttagggtattcaaagagatgacaagtcggagggttacagcagatgtgcatacttacaacatgtttatgacctttctttgcaaacatggaagaagcaaagaagctgcaggaatttttgataccatggctatgaagggcctgaaacctgacaacgtttcatatgctattctccttcatgggtatgccaccgaaggatgcttagttgatatgattaatctcttcaattcaatggaaagagattgtattctacctgactgtcgtatcttcaacatactgattaatgcatatgctaaatctgggaagcttgataaggctatgcttatcttcaatgaaatgcagaaacaaggagcgaatccagatgcagtcacgtattcaactgtaatagatgcattttgcaaaaagggtcagttggacgatgctatgataaagtttaatcagatgattgatacaggagtaccacagggcacagctgtttatggttctctaatccagggtttttgtacacacggcgatttggtgaaagcaaaggaattggttactgaaatgatgaacaaaggtatacctcctcctgatattaagttcttccattcaatcatgcagaacctttgcacagaaggaagggtaatagaagcacgggatgtccttggcttgatagcgcacataggtatgaagcctaatgtttgcacatttaatatactgagcggtggatattgcctagtcggcaagatggaggatgcctcaaaaatatttgatgatatgatgtcatatggcttagaaccttctaatattacgtatggtatacttattaatggctattgcaaaaacgaaaggattaacgatgggttgattctgttcaaagaaatgttgtgcaagggacttaaacctacaacttttaattacaacgtcatactggatggattatttctaactggacgaactgttgctgcaaaggaaaagtttgatgagatggttgaatctggagtaagtgtgtgcattgatacatattcgatagttcttggtggactttgtagaaataattgtagcggcgaagcaatcatgctattccagaaattaagcacaatggatgtgaaattcaatattacaattgtcaatataatgattgatgccttctacagggttcagcgaaaccaagaagccaaggatttgtttgctgcagtatcagccaatggtttggtagctaatgtctttacctacaccataatgatgaaaaatcttataaaagaagggtcagtggaagaagctgacgatctctttttatcaatggagaagagcggctgtactgctgactcttatatgttaaatcttatcgtcagaatgttactggaaaaaggagagctagtcaaggctgggaattatatgtctaaagttgatgcaatgagctactcacttgaagctgaaaccgtttcgctgcttatctctctcttttcagggaaagggaaatatagagaacacataggattgctccctgcaaagtatcagtttcgtgaagaagcagccacaattgtg

SEQ ID NO: 1798 - DNA, 2469 bp, Triticum aestivum
atgtcccgcctccgcctccgccactgctccaccacgcccatgtcccgcctccgccgccgccgccgcctctcctcttccacctcacgacccacaccctcctggtctccccgcgccgcctttgcggcggccacggagcgcgtccgcgacggaacgctcggccctcaagacgcacaccacctgttcgacgaattgtttcagcaggccaccccggtccccgagcgccccctcaacggattccttgccgccctcacccgtgccacgccctccgaggcctgcagagacggccccgccctcgccctctccctcttcaaccgtgtctgccgagaagaagccggcatgcgggtggcgccgcccaccatcttcacctacggcgtcctcatgaactgctgctgcaacacgcgtcgtccggaacttgggctcgccttcttcggccgcctcctaaggacgggcctgaaggcagacaagaccgtcgccaacactgtcctcaagtgcctgtgctgcgctaaacggacagacgacgctgtgaaagtgctgcttcataggatgaccgagctggggtgtgtgcctgatgccttctcatacgccattgtcctgaagagcttatgtgatgataacaggagccagcaggcgctcgacctgctccggatgatggcgaaagaagaaggtgtgtgctcccctgacgtggtcacatataacacggtcatccacggcttctttaaggaaggaaaaataggcaaggcatgcaatctattccatgaaatgacgaagcaagggtttgtgcctaatgtggtgacatataactcggttatcaatgcattgtgcaaggcccgagcaatggacaatgcagagttgttccttcggcagatggttgataacggcgttcaaccgaataaagtgacatatactagcatgatccatggatattccactttgggccggtggaaagaggcgactaaactgttcagagaaatgacaagcagtggtcttataccagatattgtcacttggaactcgttcattgactccctttgcaagcatggaagaagcaaagaagctgctgaaatttttgattccatggctgccaagggccacagacctaatattgttacgtatggcattctgctccacgggtatgcaagggaaggatgctttgctgatatgatgagtctctttaattcaatggaaggcgacggtattgtagccaactgccttgttttcaccattttaattgatgcatatgctaaacgaggaatgatggatgaagctatgctcatacttactgaaatgcagggacaaggactgagtccggatgtattcacctattcaactctaatatctgcactttgcagaaaggggaggctcgctgatgctatggataagttaagtgagatgattggtacgggagtacaaccgaatacagttgtttatcactccctaattcagggtttctgtacacatggcgatctggtgaaagcaaaggagttggtttatgaaatgatgaccaaaggtattccttgtccaaacactgcattcttcagttcaatagtacacagtctatgcaaagaaggaagggttatggatgcacaccatatctttgacttggttaaagacataggggagagatctgacatcattatgtttaatacgctgattgatggatattgcctagtcggtgagatgggcaaagcattcagtgtactagatgtcatgatatcagccggcattgagcctgacatctttacatataatacacttgtcaatggttattttaagagtggaaggatcgatgatgggttgaatctgttcagagaaatgtcacataaggaaattaaacctacaactgttacatataacatcatactggatggattatttcgtgctgggagaacagttgctgccaagaaaatgctccatgagatgatcggatgtggaacaacagtgagcttgtccacatacaccataattcttagaggactttgtagaaataattgcaccgacgaagcaatcgtcatgttccagaaattacgcacaattaatgtaaagttcaatatcacaacactcaataccatgattaattcaatgtacacggttcagagaagagaagaagctaaagatttgtttgctgcaatatcagacagcgggttggtgcccaatgcctctacatacggcataatgatacgaaatcttctaaaagaaggatcagtggaagaagctgacaatatgttctcatcaatggagaagagtggttgtgctccttgctctcgtcttttaaatgataccattagaacgttattggagaagggggaaatagtcaaggccggaaattatatgtctaaagttgatggcaagagcatctcacttgaagcttcaactagttcattgttgttgtctctgttttctgggaaaggtaaatatcgtgaacaaatacaattgctccctgtaaagtaccaattctttgatggagttagt

SEQ ID NO: 1799 - DNA, 2469 bp, Triticum aestivum
atgtcccgcctccgcctccgccactgctccaccacgcccatgtcccgcctccgccgccgccgccgcctctcctcttccacctcacgacccacaccctcctggtctccccgcgccgcctttgcggcggccacggagcgcgtccgcgacggaacgctcggccctcaagacgcacaccacctgttcgacgaattgtttcagcaggccaccccggtccccgagcgccccctcaacggattccttgccgccctcacccgtgccacgccctccgaggcctgcagagacggccccgccctcgccctctccctcttcaaccgtgtctgccgagaagaagccggcatgcgggtggcgccgcccaccatcttcacctacggcgtcctcatgaactgctgctgccacacgcgtcgtccggaacttgggctcgccttcttcggccgcctcctaaggacgggcctgaaggcagacaagaccgtcgccaacactgtcctcaagtgcctgtgctgcgctaaacggacagacgacgctgtgaaagtgctgcttcataggatgaccgagctggggtgtgtgcctgatgccttctcatacgccattgtcctgaagagcttatgtgatgataacaggagccagcaggcgctcgacctgctccggatgatggcgaaagaagaaggtgtgtgctcccctgacgtggtcacatataacacggtcatccacggcttctttaaggaaggaaaaataggcaaggcatgcaatctattccatgaaatgacgaagcaagggtttgtgcctaatgtggtgacatataactcggttatcaatgcattgtgcaaggcccgagcaacggacaatgcagagttgttccttcggcagatggttgataacggcgttcaaccgaataaagtgacatatactagcatgatccatggatattccactttgggccggtggaaagaggcgactaaactgttcagagaaatgacaagcagtggtcttataccagatattgtcacttggaactcgttcattgactccctttgcaagcatggaagaagcaaagaagctgctgaaatttttgattccatggctgccaagggccacagacctaatattgttacgtatggcattctgctccacgggtatgcaagggaaggatgctttgctgatatgatgagtctctttaattcaatggaaggcgacggtattgtagccaactgccttgttttcaccattttaattgatgcatatgctaaacaaggaatgatggatgaagctatgctcatacttactgaaatgcagggacaaggactgagtccggatgtattcacctattcaactctaatatctgcactttgcagaaaggggaagctcgctgatgctatggataagttaagtgagatgattggtacgggagtacaaccgaatacagttgtttatcactccctaattcagggtttctgtacacatggcgatctggtgaaagcaaaggagttggtttatgaaatgatgaccaaaggtattccttgtccaaacactgcattcttcagttcaatagtacacagtctatgcaaagaaggaagggttatggatgcacaccatatctttgacttggttaaagacataggggagagatctgacatcattatgtttaatacgctgattgatggatattgcctagtcggtgagatgggcaaagcattcagtgtactagatgtcatgatatcagccggcattgagcctgacatctttacatataatacacttgtcaatggttattttaagagtggaaggatcgatgatgggttgaatctgttcagagaaatgtcacataaggaaattaaacctacaactgttacatataacatcatactggatggattatttcgtgctgggagaacagttgctgccaagaaaatgctccatgagatgatcggatgtggaacaacagtgagcttgtccacatacaccataattcttagaggactttgtagaaataattgcaccgacgaagcaatcgtcatgttccagaaattacgcacaattaatgtaaagttcaatatcacaacactcaataccatgattaattcaatgtacacggttcagagaagagaagaagctaaagatttgtttgctgcaatatcagacagcgggttggtgcccaatgcctctacatacggcataatgatacgaaatcttctaaaagaaggatcagtggaagaagctgacaatatgttctcatcaatggagaagagtggttgtgctccttgctctcgtcttttaaatgataccattagaacgttattggagaagggggagatagtcaaggccggaaattatatgtctaaagttgatggcaagagcatctcacttgaagcttcaactagttcattgttgttgtctctgttttctgggaaaggtaaatatcgtgaacaaatacaattgctccctgtaaagtaccaattctttgatggagttagt

SEQ ID NO: 1800 - DNA, 2469 bp, Triticum aestivum; identical to SEQ ID NO: 1798

SEQ ID NO: 1801 - DNA, 2469 bp, Triticum aestivum; identical to SEQ ID NO: 1798

SEQ ID NO: 1802 - DNA, 2469 bp, Triticum aestivum; identical to SEQ ID NO: 1799

SEQ ID NO: 1803 - DNA, 2469 bp, Triticum aestivum
atgtcccgcctccgcctccgccactgctccaccacgcccatgtcccgcctccgccgccgccgccgcctctcctcttccacctcacgacccacaccctcctggtctccccgcgccgcctttgcggcggccacggagcgcgtccgcgacggaacgctcggccctcaagacgcacaccacctgttcgacgaattgtttcagcaggccaccccggtccccgagcgccccctcaacggattccttgccgccctcacccgtgccacgccctccgaggcctgcagagacggccccgccctcgccctctccctcttcaaccgtgtctgccgagaagaagccggcatgcgggtggcgccgcccaccatcttcacctacggcgtcctcatgaactgctgctgccacacgcgtcgtccggaacttgggctcgccttcttcggccgcctcctaaggacgggcctgaaggcagacaagaccgtcgccaacactgtcctcaagtgcctgtgctgcgctaaacggacagacgacgctgtgaaagtgctgcttcataggatgaccgagctggggtgtgtgcctgatgccttctcatacgccattgtcctgaagagcttatgtgatgataacaggagccagcaggcgctcgacctgctccggatgatggcgaaagaagaaggtgtgtgctcccctgacgtggtcacatataacacggtcatccacggcttctttaaggaaggaaaaataggcaaggcatgcaatctattccatgaaatgacgaagcaagggtttgtgcctaatgtggtgacatataactcggttatcaatgcattgtgcaaggcccgagcaacggacaatgcagagttgttccttcggcagatggttgataacggcgttcaaccgaataaagtgacatatactagcatgatccatggatattccactttgggccggtggaaagaggcgactaaactgttcagagaaatgacaagcagtggtcttataccagatattgtcacttggaactcgttcattgactccctttgcaagcatggaagaagcaaagaagctgctgaaatttttgattccatggctgccaagggccacagacctaatattgttacgtatggcattctgctccacgggtatgcaagggaaggatgctttgctgatatgatgagtctctttaattcaatggaaggcgacggtattgtagccaactgccttgttttcaccattttaattgatgcatatgctaaacgaggaatgatggatgaagctatgctcatacttactgaaatgcagggacaaggactgagtccggatgtattcacctattcaactctaatatctgcactttgcagaaaggggaagctcgctgatgctatggataagttaagtgagatgattggtacgggagtacaaccgaatacagttgtttatcactccctaattcagggtttctgtacacatggcgatctggtgaaagcaaaggagttggtttatgaaatgatgaccaaaggtattccttgtccaaacactgcattcttcagttcaatagtacacagtctatgcaaagaaggaagggttatggatgcacaccatatctttgacttggttaaagacataggggagagatctgacatcattatgtttaatacgctgattgatggatattgcctagtcggtgagatgggcaaagcattcagtgtactagatgtcatgatatcagccggcattgagcctgacatctttacatataatacacttgtcaatggttattttaagagtggaaggatcgatgatgggttgaatctgttcagagaaatgtcacataaggaaattaaacctacaactgttacatataacatcatactggatggattatttcgtgctgggagaacagttgctgccaagaaaatgctccatgagatgatcggatgtggaacaacagtgagcttgtccacatacaccataattcttagaggactttgtagaaataattgcaccgacgaagcaatcgtcatgttccagaaattacgcacaattaatgtaaagttcaatatcacaacactcaataccatgattaattcaatgtacacggttcagagaagagaagaagctaaagatttgtttgctgcaatatcagacagcgggttggtgcccaatgcctctacatacggcataatgatacgaaatcttctaaaagaaggatcagtggaagaagctgacaatatgttctcatcaatggagaagagtggttgtgctccttgctctcgtcttttaaatgataccattagaacgttattggagaagggggagatagtcaaggccggaaattatatgtctaaagttgatggcaagagcatctcacttgaagcttcaactagttcattgttgttgtctctgttttctgggaaaggtaaatatcgtgaacaaatacaattgctccctgtaaagtaccaattctttgatggagttagt

SEQ ID NO: 1804 - DNA, 2457 bp, Triticum aestivum
atgccccgcctccgtcgcttctccaccatgccgatgctccacctcctccgccgcagctcctcctccacctccacctcgccgcccttgcgttcctggtctccccacgccgcctttgccgccgccacggagcgtgtccgtgccggggcgctcagccctgaagacgcgcaccacctgttcgacgaattgctacggcaggccaccccggtccccgagcgctccctcaacggcttccttgccgccctcgcccgtgcgcccgcctcggccgcctgcattagagatggccccgcccttgccgtcgctctcttcaaccgcgtgtgccgagaagaagccggcctgcaggtggcagcgcccacagtttgcacctacaacatcctcatgggctgctgctgccgcgtgcatcgcccggacctagggcttgccttctttggtcgtctcctcaggacaggcctgaagacagaacagatcactgccaacaccttcctcaagtgcctctgctacgccaaacggacggaagaggctgtgaacatgctgcttcatgggatgtccgagctcggctgtgtgccggatgcaatctcatactccattgttctgaagagcttatgcgagaatagcatgagtcagcgggcattcgacctgctccacagcgggcactcgacctgctctttcagtgtggtggcatatagcacagtcatccatggctttttcaaagaaggcaaaacaggcaaggcatgcaatctattccatgaaatgatacatcaaggggttgatcctgatgtggtgacgtgcaactcgatcattaatgcattgtgcaaggccagagcaatggacaaggcagagctagtccttcggcagatggtcgataaaggtgttcagcccaatacagtgacttataattgcatgattcatggatattccacgtcagggcggttgaaagaggctgttaaaatgttgacagaaatgacaagccgtggtcttataccagatattgttacttacaattcgttgatgacttcccttagcaagcatcgaagaagcaaagaagcggcagaaatattttattccatgactgccaagggccacaaaccgaatgctgcctcgcaccgtattttgcttaatgggtatgccactgagggatgctttgctgatatgattgatctcttcaactcaatggaaagcaatggttttgtagccgactgccatgttttcaccatattaattgatgcatatgctaaacgtggaatgatggatgaagctatgctcatatttactgaaatgcgggaaaaaggagtgagtcccgatgtattcacctattacactgtaatagccgcactttgcagattgggtaggctggccgatgctatggacaggttcaatgagatgactgatatgggtgttcagccgaacacagttgtttatcactccctaattcagggtttttgtatgcttggtgatttggttaaagctaaggagttggtgtctgaaatgatgaacaaaggtattcctcgtcctgacattgcgttcttcagttcaataataaacagtctatgcaaagaaggaagagttatggatgcacaagatatctttgaattggttataagcatagatgagagacctgacgtcattacatttaactcactgattgatggatatggcttaattggccagatggataaagcatttggagtgcttgatgccatggtatcagctggcattgagcctaatgttgttacgtatagttcacttcttgatggctattgtagaaatggaaggatcgatgatgctttgattctattcagagaaatgccgcgcaagagaattaaacctaacactgttacatatggcatcatactgcatgggttgttccgtgctgggagaactgttgctgcaaggaaaatgttcgatgagatgatcgaagggggtataccagtgagcatttccatatacaatataatacttggaggtctttgtagaaataattgtgcagacgaagcaatcacactatttcagaaattaggagcaatgaatgtcaagttcgatattataacactcaataccatgattaatgcaatgttcaaggttcggagaagagaagaagctaatgatttgtttgctgcaatatcagccagtgggttggtgcctaatgcttctacttacggcataatgatagaaaatattctaaaagaaggatcagtggaagaagttgacaatatgttttcatcaatggagaagagtggttgtgctcccagctctcgtcttataaattgtatcatcagaatgttgttggaaaaaggtgagattgccagggctgggaattatttatctaaagttgatgggaagatcatctcacttgaagcttcaactacttctttgttgttgtctctcttttcaagggaagggaaatatcgggaaaacattgaattgcttcctgcaaagtatcaatttttcattggatttggt

SEQ ID NO: 1805 - DNA, 1710 bp, Triticum aestivum
atgatacatcaaggggttgatcctgatgtggtgacgtacaactcgatcattgatggattgtgcaaggccagagcaatggacaaggcagagctagtccttcggcagatggtcgataaaggtgttcaacccaatacagtgacatataattgcatgattcatggatattccacatcagggcggttgaaagaggctgttaaaatgttgacagaaatgacaagccgtggtcttataccagatattgttacttacaattcgttgatgacttccctttgcaagcatggaagaagcaaagaagtggcagaaatattttattccatgactgccaagggccacaaaccgaatgctgcctcgtaccgtattttgcttaatgggtatgccactgagggatgctttgctgatatgattgatctcttcaactcaagggaaagcaatagttttgtatccgactgccatgttttcaccatattaattgatgcatatgctaaacgtggaatgatggatgaagctatgctcatatttactgaaatgcgggaaaaaggagtgagtcccgatgtattcacctattacactgtaatagccgcactttgcagattgggtaggctggccgatgctatggacaggttcaatgagatgactgatatgggtgttcagccgaacacagttgtttatcactccctaattcagggtttttgtatgcttggtgatttggttaaagctaaggagttggtgtctgaaatgatgaacaaaggtattcctcgtcctgacattgcattcttcagttcaataataaacagtctatgcaaagaaggaagagttatggatgcacaagatatctttgaattggttataagcatagatgagagacctgacgtcattacatttaactcactgattgatggatatggcttaattggccagatggataaagcatttggagtgcttgatgccatggtatcagctggcattgagcctaatgttgttacgtatagttcacttcttgatggctattgtagaaatggaaggatcgatgatgctttgattctattcagagaaatgccgcgcaagagaattaaacctaacactgttacatatggcatcatactggatgggttgttccgtgctgggagaactgttgctgcaaggaaaatgttcgatgagatgatcgaagggggtataccagtgagcatttccatatacaatataatacttggaggtctttgtagaaataattgtgcagacgaagcaatcacactattccagaaattaggagcaatgaatgtcaagttctatattataacactcaataccatgattaatgcaatgttcaaggttcggagaagagaagaagctaacgatttgtttgctgcaatatcagccagtgggttggtgcctaatgcttctacttacggcataatgatagaaaatattctaaaagaaggatcagtggaagaagttgacaatatgttttcatcaatggagaagagtgattgtgctcccagctctcgtcttataaattatatcatcagaatgttgttggaaaaaggtgagattgccagggccgggaattatttatctaaagttgatgggaagatcatctcacttgaagcttcaactacttctttgttgttgtctctcttttcaagggaagggaaatatcgggaaaacattgaattgcttcctgcaaagtatcaatttttcaatggatttggt

SEQ ID NO: 1806 - DNA, 1710 bp, Triticum aestivum; identical to SEQ ID NO: 1805

SEQ ID NO: 1807 - DNA, 1191 bp, Triticum aestivum
atgatacatcaaggggttgatcctgatgtggtgacgtacaactcgatcattgatggattgtgcaaggccagagcaatggacaaggcagagctagtccttcggcagatggtcgataaaggtgttcaacccaatacagtgacatataattgcatgattcatggatattccacatcagggcggttgaaagaggctgttaaaatgttgacagaaatgacaagccgtggtcttataccagatattgttacttacaattcgttgatgacttccctttgcaagcatggaagaagcaaagaagcggcagaaatattttattccatgactgccaagggccacaaaccgaatgctgcctcgtaccgtattttgcttaatgggtatgccactgagggatgctttgctgatatgattgatctcttcaactcaatgaaaagcaatggttttgtagctgactgccatgttttcaccatattaattgatgcatatgctaaacgtggaatgatggatgaagctatgctcatatttactgaaatgcgggaaaaaggagtgagtcccgatgtattcacctattacactgtaatagccgcactttgcagattgggtaggctggccgatgctatggacaggttcaatgagatgactgatatgggtgttcagccgaacacagttgtttatcactccctaattcagggtttttgtatgcttggtgatttggttaaagctaaggagttggtgtctgaaatgatgaacaaaggtattcctcgtcctgacattgcattcttcagttcaataataaacagtctatgcaaagaaggaagagttatggatgcacaagatatctttgaattggttataagcatagatgagagacctgacgtcattacatttaactcactgattgatggatatggcttaattggccagatggataaagcatttggagtgcttgatgccatggtatcagctggcattgagcctaatgttgttacgtatagttcacttcttgatggctattgtagaaatggaaggatcgatgatgctttgattctattcagagaaatgccgcgcaagagaattaaacctaacactgttacatatggcatcatactggatgggttgttcagtgctgggagaactgttgctgcaaggaaaatgttcgatgagatgatcgaagggggtaagcccagctcacgctgc

SEQ ID NO: 1808 - DNA, 2457 bp, Triticum aestivum
atgccccgcctccgtcgcttctccaccatgccgatgctccacctcctccgccgcagctcctcctccacctccacctcgccgcccttgcgttcctggtctccccacgccgcctttgccgccgccacggagcgtgtccgtgccggggcgctcagccctgaagacgcgcaccacctgttcgacgaattgctacggcaggccaccccggtccccgagcgctccctcaacggcttccttgccgccctcgcccgtgcgcccgcctcggccgcctgcattagagatggccccgcccttgccgtcgctctcttcaaccgcgtgtgccgagaagaagccggcctgcaggtggcagcgcccacagtttgcacctacaacatcctcatgggctgctgctgccgcgtgcatcgcccggacctagggcttgccttctttggtcgtctcctcaggacatgcctgaagacagaacagatcactgccaacaccttcctcaagtgcctctgctacgccaaacggacggaagaggctgtgaacatgctgcttcatgggatgtccgagctcggctgtgtgccggatgcaatctcatactccattgttctgaagagcttatgcgagaatagcatgagtcagcgggcattcgacctgctccacagcgggcactcgacctgctctttcagtgtggtggcatatagcacagtcatccatggcttttttaaagaaggcaaaacaggcaaggcatgcaatctattccatgaaatgatacatcaaggggttgatcctgatgtggtgacgtacaactcgatcattaatgcattgtgcaaggccagagcaatggacaaggcagagctagtccttcggcagatggtcgataaaggtgttcagcccaatacagtgacttataattgcatgattcatggatattccacgtcagggcggttgaaagaggctgttaaaatgttgacagaaatgacaagccgtggtcttataccagatattgttacttacaattcgttgatgacttcccttagcaagcatcgaagaagcaaagaagcggcagaaatattttattccatgactgccaagggccacaaaccgaatgctgcctcgtaccgtattttgcttaatgggtatgccactgagggatgctttgctgatatgattgatctcttcaactcaatggaaagcaatggttttgtagccgactgccatgttttcaccatattaattgatgcatatgctaaacgtggaatgatggatgaagctatgctcatatttactgaaatgcgggaaaaaggagtgagtcccgatgtattcacctattacactgtaatagccgcactttgcagattgggtaggctggccgatgctatggacaggttcaatgagatgactgatatgggtgttcagccgaacacagttgtttatcactccctaattcagggtttttgtatgcttggtgatttggttaaagctaaggagttggtgtctgaaatgatgaacaaaggtattcctcgtcctgacattgcgttcttcagttcaataataaacagtctatgcaaagaaggaagagttatggatgcacaagatatctttgaattggttataagcatagatgagagacctgacgtcattacatttaactcactgattgatggatatggcttaattggccagatggataaagcatttggagtgcttgatgccatggtatcagctggcattgagcctaatgttgttacgtatagttcacttcttgatggctattgtagaaatggaaggatcgatgatgctttgattctattcagagaaatgccgcgcaagagaattaaacctaacactgttacatatggcatcatactgcatgggttgttccgtgctgggagaactgttgctgcaaggaaaatgttcgatgagatgatcgaagggggtataccagtgagcatttccatatacaatataatacttggaggtctttgtagaaataattgtgcagacgaagcaatcacactatttcagaaattaggagcaatgaatgtcaagttcgatattataacactcaataccatgattaatgcaatgttcaaggttcggagaagagaagaagctaatgatttgtttgctgcaatatcagccagtgggttggtgcctaatgcttctacttacggcataatgatagaaaatattctaaaagaaggatcagtggaagaagttgacaatatgttttcatcaatggagaagagtggttgtgctcccagctctcgtcttataaattgtatcatcagaatgttgttgggaaaaggtgagattgccagggccgggaattatttatctaaagttgatgggaagatcatctcacttgaagcttcaactacttctttgttgttgtctctcttttcaagggaagggaaatatcgggaaaacattgaattgcttcctgcaaagtatcaatttttcattggatttggt

SEQ ID NO: 1809 - DNA, 1710 bp, Triticum aestivum
atgatacatcaaggggttgatcctgatgtggtgacgtacaactcgatcattgatggattgtgcaaggccagagcaatggacaaggcagagctagtccttcggcagatggtcgataaaggtgttcaacccaatacagtgacatataattgcatgattcatggatattccacatcagggcggttgaaagaggctgttaaaatgttgacagaaatgacaagccgtggtcttataccagatattgttacttacaattcgttgatgacttccctttgcaagcatggaagaagcaaagaagcggcagaaatattttattccatgactgccaagggccacaaaccgaatgctgcctcgtaccgtattttgcttaatgggtatgccactgagggatgctttgctgatatgattgatctcttcaactcaatgaaaagcaatggttttgtagctgactgccatgttttcaccatattaattgatgcatatgctaaacgtggaatgatggatgaagctatgctcatatttactgaaatgcgggaaaaaggagtgagtcccgatgtattcacctattacactgtaatagccgcactttgcagattgggtaggctggccgatgctatggacaggttcaatgagatgactgatatgggtgttcagccgaacacagttgtttatcactccctaattcagggtttttgtatgcttggtgatttggttaaagctaaggagttggtgtctgaaatgatgaacaaaggtattcctcgtcctgacattgcattcttcagttcaataataaacagtctatgcaaagaaggaagagttatggatgcacaagatatctttgaattggttataagcatagatgagagacctgacgtcattacatttaactcactgattgatggatatggcttaattggccagatggataaagcatttggagtgcttgatgccatggtatcagctggcattgagcctaatgttgttacgtatagttcacttcttgatggctattgtagaaatggaaggatcgatgatgctttgattctattcagagaaatgccgcgcaagagaattaaacctaacactgttacatatggcatcatactggatgggttgttccgtgctgggagaactgttgctgcaaggaaaatgttcgatgagatgatcgaagggggtataccagtgagcatttccatatacaatataatacttggaggtctttatagaaataattgtgcagacgaagcaatcacactattccagaaattaggagcaatgaatgtcaagttctatattataacactcaataccatgattaatgcaatgttcaaggttcggagaagagaagaagctaacgatttgtttgctgcaatatcagccagtgggttggtgcctaatgcttctacttacggcataatgatagaaaatattctaaaagaaggatcagtggaagaagttgacaatatgttttcatcaatggagaagagtgattgtgctcccagctctcgtcttataaattatatcatcagaatgttgttggaaaaaggtgagattgccagggccgggaattatttatctaaagttgatgggaagatcatctcacttgaagcttcaactacttctttgttgttgtctctcttttcaagggaagggaaatatcgggaaaacattgaattgcttcctgcaaagtatcaatttttcaatggatttggt

SEQ ID NO: 1810 - DNA, 1710 bp, Triticum aestivum; identical to SEQ ID NO: 1809

SEQ ID NO: 1811 - DNA, 2457 bp, Triticum aestivum; identical to SEQ ID NO: 1804

SEQ ID NO: 1812 - DNA, 2457 bp, Triticum aestivum
atgccccgcctccgtcgcttctccaccatgccgatgctccacctcctccgccgcagctcctcctccacctccacctcgccgcccttgcgttcctggtctccccacgccgcctttgccgccgccacggagcgtgtccgtgccggggcgctcagccctgaagacgcgcaccacctgttcgacgaattgctacggcaggccaccccggtccccgagcgctccctcaacggcttccttgccgccctcgcccgtgcgcccgcctcggccgcctgcattagatatggccccgcccttgccgtcgctctcttcaaccgcgtgtgccgagaagaagccggcctgcaggtggcagcgcccacagtttgcacctacaacatcctcatgggctgctgctgccgcgcgcatcgcccggacctagggcttgccttctttggtcgtctcctcaggacaggcctgaagacagaacagatcactgccaacaccttcctcaagtgcctctgctacgccaaacggacggaagaggctgtgaacgtgctgcttcatgggatgtccgagctcggctgtgtgccggatgcaatctcatactccattgttctgaagagcttatgcgagaatagcatgagtcagcgggcactcgacctgctccacagcgggcactcgacctgctctttcagtgtggtggcatatagcacagtcatccatggcttttttaaagaaggcaaaacaggcaaggcatgcaatctattccatgaaatgatacatcaaggggttgatcctgatgtggtgacgtacaactcgatcattaatgcattgtgcaaggccagagcaatggacaaggcagagctagtccttcggcagatggtcgataaaggtgttcagcccaatacagtgacttataattgcatgattcatggatattccacgtcagggcggttgaaagaggctgttaaaatgttgacagaaatgacaagccgtggtcttataccagatattgttacttacaattcgttgatgacttccctttgcaagcatcgaagaagcaaagaagcggcagaaatattttattccatgactgccaagggccacaaaccgaatgctgcctcgtaccgtattttgcttaatgggtatgccactgagggatgctttgctgatatgattgatctcttcaactcaatggaaagcaatggttttgtagccgactgccatgttttcaccatattaattgatgcatatgctaaacgtggaatgatggatgaagctatgctcatatttactgaaatgcgggaaaaaggagtgagtcccgatgtattcacctattacactgtaatagccgcactttgcagattgggtaggctggccgatgctatggacaggttcaatgagatgactgatatgggtgttcagccgaacacagttgtttatcactccctaattcagggtttttgtatgcttggtgatttggttaaagctaaggagttggtgtctgaaatgatgaacaaaggtattcctcgtcctgacattgcgttcttcagttcaataataaacagtctatgcaaagaaggaagagttatggatgcacaagatatctttgaattggttataagcatagatgagagacctgacgtcattacatttaactcactgattgatggatatggcttaattggccagatggataaagcatttggagtgcttgatgccatggtatcagctggcattgagcctaatgttgttacgtatagttcacttcttgatggctattgtagaaatggaaggatcgatgatgctttgattctattcagagaaatgccgcgcaagagaattaaacctaacactgttacatatggcatcatactgcatgggttgttccgtgctgggagaactgttgctgcaaggaaaatgttcgatgagatgatcgaagggggtataccagtgagcatttccatatacaatataatacttggaggtctttgtagaaataattgtgcagacgaagcaatcacactatttcagaaattaggagcaatgaatgtcaagttcgatattataacactcaataccatgattaatgcaatgttcaaggttcggagaagagaagaagctaatgatttgtttgctgcaatatcagccagtgggttggtgcctaatgcttctacttacggcataatgatagaaaatattctaaaagaaggatcagtggaagaagttgacaatatgttttcatcaatggagaagagtggttgtgctcccagctctcgtcttataaattgtatcatcagaatgttgttggaaaaaggtgagattgccagggccgggaattatttatctaaagttgatgggaagatcatctcacttgaagcttcaactacttctttgttgttgtctctcttttcaagggaagggaaatatcgggaaaacattgaattgcttcctgcaaagtatcaatttttcattggatttggt

SEQ ID NO: 1813 - DNA, 2457 bp, Triticum aestivum; identical to SEQ ID NO: 1804

SEQ ID NO: 1814 - DNA, 2457 bp, Triticum aestivum; identical to SEQ ID NO: 1804

SEQ ID NO: 1815 - DNA, 1395 bp, Triticum aestivum
  misc_feature (50)..(50): n is a, c, g, or t
  misc_feature (52)..(56): n is a, c, g, or t
  misc_feature (59)..(59): n is a, c, g, or t
  misc_feature (61)..(61): n is a, c, g, or t
atgactgccaagggccacaaaccgaatgctgcctcgcaccgtattttgcntnnnnngyntnycactgagggatgctttgctgatatgattgatctcttcaactcaatggaaagcaatggttttgtagccgactgccatgttttcaccatattaattgatgcatatgctaaacgtggaatgatggatgaagctatgctcatatttactgaaatgcgggaaaaaggagtgagtcccgatgtattcacctattacactgtaatagccgcactttgcagattgggtaggctggccgatgctatggacaggttcaatgagatgactgatatgggtgttcagccgaacacagttgtttatcactccctaattcagggtttttgtatgcttggtgatttggttaaagctaaggagttggtgtctgaaatgatgaacaaaggtattcctcgtcctgacattgcrttcttcagttcaataataaacagtctatgcaaagaaggaagagttatggatgcacaagatatctttgaattggttataagcatagatgagagacctgacgtcattacatttaactcactgattgatggatatggcttaattggccagatggataaagcatttggagtgcttgatgccatggtatcagctggcattgagcctaatgttgttacgtatagttcacttcttgatggctattgtagaaatggaaggatcgatgatgctttgattctattcagagaaatgccgcgcaagagaattaaacctaacactgttacatatggcatcatactggatgggttgttccgtgctgggagaactgttgctgcaaggaaaatgttcgatgagatgatcgaagggggtataccagtgagcatttccatatacaatataatacttggaggtctttatagaaataattgtgcagacgaagcaatcacactattccagaaattaggagcaatgaatgtcaagttctatattataacactcaataccatgattaatgcaatgttcaaggttcggagaagagaagaagctaacgatttgtttgctgcaatatcagccagtgggttggtgcctaatgcttctacttacggcataatgatagaaaatattctaaaagaaggatcagtggaagaagttgacaatatgttttcatcaatggagaagagtgattgtgctcccagctctcgtcttataaattatatcatcagaatgttgttggaaaaaggtgagattgccagggccgggaattatttatctaaagttgatgggaagatcatctcacttgaagcttcaactacttctttgttgttgtctctcttttcaagggaagggaaatatcgggaaaacattgaattgcttcctgcaaagtatcaatttttcaatggatttggt

SEQ ID NO: 1816 - DNA, 1710 bp, Triticum aestivum; identical to SEQ ID NO: 1805

SEQ ID NO: 1817 - DNA, 2457 bp, Triticum aestivum; identical to SEQ ID NO: 1804

SEQ ID NO: 1818 - DNA, 1506 bp, Triticum aestivum
atgttggacatcggcgtcgtgaaggatcggcggaggcggaggcggaacaacggggcgaggaatgataccggggaccggaattgctgctgcatggaaacaatgatgccggggcgctccctcaacggcttcctcgccgccctcgcacgtgctacgtcctctgccgcccccgcctgcatcagagatggtcctgtcctcgtcgtcgccctcttcaaccgcttgtgccgagaacaagccgtcgtgcgggtggcgcctctcacagtccacacctacggcatcctcatggactgctgctgccgcacgtctcgcccggacctaggtcttgccttcttcggtcgcctcctcaggacaggcctcaagacaaatgagatcgttgccaccaccttcctcaagtgcctctgctacgcaaaacggacggatgaggctgtgaacgtgctgcttcataggatgcccgagctcggctgtgtgcctgacgccttcgcatactccactgttctgaagagcttatgcgacaatagcatgagtcagcaggggctcgacctgctccatatgatggcgaaagaaggaggtggctgctcccccaacgtggtggcgtatagcacagtcatccatggcttctttaaggaaggtgaaataggcaaggcatgcaatctgttccatgaaatgatgcagcaaggtgttgagcccaatgtgtggacatatagttcaatcattgatgcattgtgcaaggccagagcaatggacaaggcagagctagtgcttcagcagatggttaacaaaggtgttcaacccaataatgtgacatatagttgcatgatccatggatattccacatctgggaggtggaaagaggctgctaaattgctcagagaaatgaaaagccggggccttatactagatattgtcactcgcaactcgttcctggcctccctttgcaagcatgggaggagcaaggaagctgcagaatttcttgattccatgactgccaagggccacaaaccagatatcgtatcatactgtattttgcttcatgggtatggtactgaaggatgcttcgctgatatgattgatgtcttttattcaatggaaagcaacggtattgcagctgactgccatgttttcaacatattaattaatggatatgcaaaacgtggaatgacagaagaagctatgctgatatttactgaaatgcggggacaaggagtaagtccagatgtagtcacctattccattgtaatagcagcactttccagaatgggcaagctgaccgatgctattgagaaattcaatgagatgactgccttggaagtacagccggacacaactgtttatcactcactgattcagggttgttgcatagacggtgatttggttaaagctaaggagctgatgtttgaaatgatgaacggtggtattcctcggcctaacattgtgttcttcaattcagtaataaacagtctgtgcaaagaaggaagggttatggatgcacatgatgtcttagacttgtta

SEQ ID NO: 1819 - DNA, 792 bp, Triticum aestivum
atggataaagcattcaaaatacttgatgtcatggaatcagttggtgttgagcctaatgttgttacttatagtacacttcttgatggctattctaaaaacagaaggattgatgatgctttgactttgtttagagaaatgccgcgtaagagaattaaacctgacactgttacatatggcatcatgttggatgggttgtttcgtgctgggagaactgtcgctgcaatggaaatgttccatgagatgattgaaagtggaacaacagtggacattctcatatacaatataaaacttggaggtctttgtagacataattgtgtagatgaagcgattgcactgttccagaaattgcgagcaatgaatgtgaagttcaatattgaaatactcaataccatgattaatgcaatgtacaaggttcaaagaaaggaagaagcaaaggaattgtttgctacaatatcagccaatgggttggtgcccaatgaatctacttatgcagtaatgataagaaatcttctgaaagacggagcagtggaagatgctgacaatatgttttcatcaatggacaacagtggtatcgttcccagttcccgtcttataaatgatatcatcagaatgttgttggaaaaaggtgagatagccaaggctggaaattatttgtctaaagttgatgggaagagtatctcacttgaagcttcaactacctcattgatgttgtctctcttttcaaggaaagggaaacaccaggaggacattaagttgctccctgcaaagtatcaaatttttgatggatttagt

SEQ ID NO: 1820 - DNA, 2466 bp, Triticum aestivum
atggccgaaattcggccgaaatccacattttgcggccgaaaatcaaaacacacggtgggggtggaggtggaggaggagctgcggcggaggaggcggatgttggacatcggcgtcgtgaaggatcggcggaggcggaggcggaacaacggggcgaggaatgataccggggaccggaattgctgctgcatggaaacaatgatgccggggcgctccctcaacggcttcctcgccgccctcgcacgtgctacgtcctctgccgcccccgcctgcatcagagatggtcctgtcctcgtcgtcgccctcttcaaccgcttgtgccgagaacaagccgtcgtgcgggtggcgcctctcacagtccacacctacggcatcctcatggactgctgctgccgcacgtctcgcccggacctaggtcttgccttcttcggtcgcctcctcaggacaggcctcaagacaaacgagatcaccgccaccaccttcctcaagtgcctctgctacgcaaaacggacggatgaggctgtgaacgtgctgcttcataggatgcccgagctcggctgtgtgcctgacgccttcgcatactccactgttctgaagagcttatgcgacaatagcatgagtcagcaggggctcgacctgctccatatgatggcgaaagaaggaggtggctgctcccccaacgtggtggcgtatagcacagtcatccatggcttctttaaggaaggtgaaataggcaaggcatgcaatctgttccatgaaatgatgcagcaaggtgttgagcccaatgtgtggacatatagttcaatcattgatgcattgtgcaaggccagagcaatggacaaggcagagctagtgcttcagcagatggttaacaaaggtgttcaacccaataatgtgacatatagttgcatgatccatggatattccacatctgggaggtggaaagaggctgctaaattgctcagagaaatgaaaagccggggccttatactagatattgtcactcgcaactcgttcctggcctccctttgcaagcatgggagaagcaaggaagctgcagaatttcttgattccatgactgccaagggccacaaaccagatatcgtatcatactgtattttgcttcatgggtatggtactgaaggatgcttcgctgatatgattgatgtcttttattcaatggaaagcaacggtattgcagctgactgccatgttttcaacatattaattaatggatatgcaaaacgtggaatgacagaagaagctatgctgatatttactgaaatgcggggacaaggagtaagtccagatgtagtcacctattccattgtaatagcagcactttccagaatgggcaagctgaccgatgctattgagaaattcaatgagatgactgccttggaagtacagccggacacaactgtttatcactcactgattcagggttgttgcatagacggtgatttggttaaagctaaggagctgatgtttgaaatgatgaacggtggtattcctcggcctaacattgtgttcttcaattcagtaataaacagtctgtgcaaagaaggaagggttatggatgcacatgatgtcttagacttggttataggcataggtgagaggcctaatgtcattacatttaattcactgattgacggatattgcttagtcgggaacatggataaagcattcaaaatacttgatgtcatggaatcagttggtgttgagcctaatgttgttacttatagtacacttcttgatggctattctaaaaacagaaggattgatgatgctttgactttgtttagagaaatgccgcgtaagagaattaaacctgacactgttacatatggcatcatgttggatgggttgtttcgtgctgggagaactgtcgctgcaatggaaatgttccatgagatgattgaaagtggaacaacagtggacattctcatatacaatataaaacttggaggtctttgtagaaataattgtgtagatgaagcgattgcactgttccagaaattgcgagcaatgaatgtgaagttcaatattgaaatactcaataccatgattaatgcaatgtacaaggttcaaagaaaggaagaagcaaaggaattgtttgctacaatatcagccaatgggttggtgcccaatgaatctacttatgcagtagtgataagaaatcttctaaaaggcggagcagtagaagatgctgacaatatgttttcatcaaaagacaacagtggcatcgttcccagttcccgtcttataaatgatatcatcagaatgttgttggaaaaaggtgagatagccaaggctggcaattatttgtctaaagttgatgggaagagtatctcacttgaagcttcaactgcctcattgatgttgtctctcttttcaaggaaagggaaacatcaggaggatattaagttgctccctgcaaagtatcagttttttgatgggtttggt

SEQ ID NO: 1821 - DNA, 1506 bp, Triticum aestivum; identical to SEQ ID NO: 1818

SEQ ID NO: 1822 - DNA, 792 bp, Triticum aestivum; identical to SEQ ID NO: 1819

SEQ ID NO: 1823 - DNA, 2466 bp, Triticum aestivum; identical to SEQ ID NO: 1820

SEQ ID NO: 1824 - DNA, 2466 bp, Triticum aestivum; identical to SEQ ID NO: 1820

SEQ ID NO: 1825 - DNA, 1506 bp, Triticum aestivum; identical to SEQ ID NO: 1818

SEQ ID NO: 1826 - DNA, 792 bp, Triticum aestivum; identical to SEQ ID NO: 1819

SEQ ID NO: 1827 - DNA, 1176 bp, Triticum aestivum
atgagtcagcaggggctcgacctgctccatatgatggcgaaagaaggaggtggctgctcccccaacgtggtggcgtatagcacagtcatccatggcttctttaaggaaggtgaaataggcaaggcatgcaatctgttccatgaaatgatgcagcaaggtgttgagcccaatgtgtggacatatagttcaatcattgatgcattgtgcaaggccagagcaatggacaaggcagagctagtgcttcagcagatggttaacaaaggtgttcaacccaataatgtgacatatagttgcatgatccatggatattccacatctgggaggtggaaagaggctgctaaattgctcagagaaatgaaaagccggggccttataccagatattgtcactcgcaactcgttcctggcctccctttgcaagcatgggagaagcaaggaagctgcagaatttcttgattccatgactgccaagggccacaaaccagatatcgtatcatactgtattttgcttcatgggtatggtactgaaggatgcttcgctgatatgattgatctctttaattcaatggaaagcaacggtattgcagccgactgccatgttttcaacatattaattaatggatatgcaaaacgtggaatgacagaagaagctatgctgatatttactgaaatgcggggacgagtaagtccagatgtagtcacctattccattgtaatagcagcactttccagaatgggcaagctgaccgatgctattgagaaattcaatgagatgactgccttggaagtacagccggacacaactgtttatcactcactgattcagggttgttgcatagacggtgatttggttaaagctaaggagctgatgtttgaaatgatgaacggtggtattcctcggcctaacattgtgttcttcaattcagtaataaacagtctgtgcaaagaaggaagggttatggatgcacatgatgtcttagacttggttataggcataggtgagaggcctaatgtcattacatttaattcactgattgatggatattgcttagtcgggaacatggataaagcattcaaaatacttgatgtcatggaatcagttggtgttgagcctaatgttgttacttatagtgcaatcttgatggctattctaaaaacagaaggattgatgatgctt

SEQ ID NO: 1828 - DNA, 2307 bp, Triticum aestivum
atgccagccgcccgcctgtcctccttcaaggctccttcacgagagcgccgacctcccctcgccgccttggctgccgccacggagcgcgtccgcgccggaacgctaagtcggcaggacgcgcaccacctgttcgacgaattgctgagccaagccgcgacagtcccagtacgcaagctgaacaactttcttgccgccctcgcccgtgcaccgccctcagctgcctgcagcgatggtccgggccttgccatcgccctcttcaaccgcatgtcccgaggcgctggtgcacgggtggtgtcgcccacgctctgtacctattccatcctcatggactgctgctgccgtgcacgccgcccggacttggtggttgccttcttcggccgcctcctcaggttggggctgcgcttggaggtcatctccttcaacaatctcctcaaggggctttgccaggccaagcgctcaaatgaggctttggacatgctgctccaccggacacctgaactacactgtgcgcctgatgtcttctcgtacaacatagtaatcaacggctgcttgaaagaaggtgaagtagacaaagcgtgcaatctcttccatgagatgccccaactgggagttcaacctgatgtggtgacctacacctcaatcatggacgcactaagcaagtccggagcaatggacaaggcagaagtgctccttcggcaaatggttgatcaaggaattgaacccaatatcaagacatatagctatctgatccatggatattctacttttggtcagtggaaggaggcacttagggtattcaaagaaatggcaagtcttggtgttgtaccagacgttgtcacgttgacctcattaatcgattccctttgcaagcacagaaggacaaaggaagctagagaaatttttgactctatggctgcaaagggcctgaaacctaatatcgtctcctactctactatgcctaatgggtatgtcaaagaaggatccttcgaggatatgactgatctcttcaattcgatggtacggaatggtatcgtacctaaccaccatattttcaacatactgatcaatgcatatgctaaacgtggagtgatggatgaggctatgcacatgttcgaagtaatgaggcaacaaggagtaaacccggatgtatttgactatcaaatcataatggattcactttgcaaaatgggtaggatggatgctgctctggacaaatttaatcagatggtcaatcaaggagtttcacctaacaaagctgtttaccaatgcctggttctgggttcttgctctcatggtcattttgtgaaagccaaggaattgatttctgaagtggttaatagaggtctgtgttctaacactgtgttcttctatcctgtaataaacggcctttgcaaagaaggaaaggtaaaggaggcacaggatatgtttgacttcatcctaggtattggtcagcggcctgatgtgattatgtacacttcactgatggatggatattgccttgttggcgaggtggagaaagcactgagtgtactcgatgctatgaaatctgctggccttcaacctgatgatgttgtatatgctacacttcttaacggttactgtaaaattggaaggatcgccgatggattgagccttttcagggaaatgtcactcagcggggttaagcccatgactattatatacaacattatactggatgggctgttttgctctgggagaacagtttgtgcaaaggaaaaattcaatacgatgactgaaagtggcataccagtgggcgttgacacatacaacatagttcttagtggactttgtagaaacaattgcactgatgaagcaatagagctgttcaagaaactacgtgcaacgaacgtgaagattgatgtcataacactcactaccatgatttctgcaatgtttaaaactaggagaattgaagaggccaaggatttgtttgctactatatcagccattgggttcatgccttctgttgtgacttacagtgtaatgatgacaaatttcataaaagaagggttgctggcagaggctgatgatatgtttttaacaatggagaaggctagctgtgcttccaactccagtctgctaaatcaagtggtcagggcgttgctggaaaaaggtgcagttgtaaaggctgcaacttatctcgctaaacttgatgctaaacagctgtcagttgaagcttcaacgatttcgttaatagtatctctcttctcaagggaagggaaactaagggagcatgtagagttgcttccagtaaagtaccagcctcctcagagttcggctgacaat

SEQ ID NO: 1829 - DNA, 2307 bp, Triticum aestivum; identical to SEQ ID NO: 1828

SEQ ID NO: 1830 - DNA, 1218 bp, Triticum aestivum
atggatgaggctatgcacatgttcgaagtaatgaggcaacaaggagtaaacccggatgtatttgactatcaaatcataatggattcactttgcaaaatgggtaggatggatgctgctctggacaaatttaatcagatggtcaatcaaggagtttcacctaacaaagctgtttaccaatgcctggttctgggttcttgctctcatggtcattttgtgaaagccaaggaattgatttctgaagtggttaatagaggtctgtgttctaacagtgtgttcttctatcctgtaataaacggcctttgcaaagaaggaaaggtaaaggaggcacaggatatgtttgacttcatcctaggtattggtcagcggcctgatgtgattatgtacacttcactgatggatggatattgccttgttggcgaggtggagaaagcactgagtgtactcgatgctatgaaatctgctggccttcaacctgatgatgttgtatatgctacacttcttaacggttactgtaaaattggaaggatcgccgatggattgagccttttcagggaaatgtcactcagcggggttaagcccatgactattatatacaacattatactggatgggctgttttgctccgggagaacagtttgtgcaaaggaaaaattcaatacgatgactgaaagtggcataccagtgggcgttgacacatacaacatagttcttagtggactttgtagaaacaattgcactgatgaagcaatagagctgttcaagaaactacgtgcaacgaacgtgaagattgatgtcataacactcactaccatgatttctgcaatgtttaaaactaggagaattgaagaggccaaggatttgtttgctactatatcagccattgggttggtgccttctgttgtgacttacagtgtaatgatgacgaatttcataaaagaagggttgctggcagaggctgatgatatgtttttaacaatggagaaggctagctgtgcttccaactccagtctgctaaatcaagtggtcagggcgttgctggaaaaaggtgcagttgtaaaggctgcaacttatctcgctaaacttgatgctaaacagctgtcagttgaagcttcaacgatttcgttaatagtatctctcttctcaagggaagggaaactaagggagcatgtagagttgcttccagtaaagtaccagcctcctcagagttcggctgacaat

SEQ ID NO: 1831 - DNA, 2307 bp, Triticum aestivum; identical to SEQ ID NO: 1828

SEQ ID NO: 1832 - DNA, 825 bp, Triticum aestivum
atggatggatattgccttgttggcgaggtggagaaagcactgagtgtactcgatgctatgaaatctgctggccttcaacctgatgatgttgtatatgctacacttcttaacggttactgtaaaattggaaggatcgccgatggattgagccttttcagggaaatgtcactcagcggggttaagcccacgactattatatacaacattatacttgatgggctgttttgctctgggagaacagtttgtgcaaaggaaaaattcaatacgatgactgaaagtggcataccagtgggcgttgacacatacaacatagttcttagtggactttgtagaaacaattgcactgatgaagcaatagagctgttcaagaaactacgtgcaacgaacgtgaagattgatgtcataacattcaataccatgatttctgcaatgtttaaaactaggagaattgaagaggccaaggatttgtttgctactatatcagccattgggttggtgccttctgttgtgacttacagtgtaatgatgacgaatttcataaaagaagggttgctggcagaggctgatgatatgtttttaacaatggagaaggctagctgtgctcccaactccagtctgctaaatcaagtggtcagggcgttgctggaaaaaggtgcagttgtaaaggctgcaacttatctcgctaaacttgatgctaaacagctgtcagttgaagcttcaatgatttcgttaatagtatctctcttctcaagggaagggaaactaagggagcatgtagagttgcttccagtaaagtaccagcctcctcagagttcggctgacaat

SEQ ID NO: 1833 - DNA, 2355 bp, Triticum aestivum
atgtcgccactccgcctccgcctccgcctccggccccgcctccatgcccgccactcctactccacctcgcatccctcacgcagccagggctgggatccccacgccgccttcgctgctgccacggagcgagctcgatctggcaacctcacctcggaggacgcacacaagctgttcgaccaattgctcctgcaggctaatccggtcaacatgcgccttcccaacgaccttctcaccgccctggctcgcgcgcctgcgtccgcagcctgcagcaacggccccgcccttgccctcgccctcttcagccgtttgtcccaaggtgcccgccaacgggtggtgcagccaacggcctgcacctacggcatcctcatggactgctgctgccgcgcaaaccgccaggatctggcgctcgccttcttcgcccgtctcctcaggacgggactcaaggcaggcgtcatagaagtcaacactcttctcaagggactctgccgcgcaaagcgggctgatgaggctctggacattctgcttcacaggatgcctgagctaggctgcacccccaacgtggtggcatataacacggtcatccatggcttcttccaagaaggccaagcaggcaaggcgtgcagcttgttccatgaaatggcgcagcagggcgttgcgcctagtttggtgacatataactcggttattgatgcgctgtgcaaggccagagccatggacaaggcagagtatttccttcgtcagatggttgatgatggtgtcgtacctgataatgtgacatataatagcctcatccatggatattcctcttcaggccactggaaggaggcagttagggtattcaaagagatgacaagtcggagggttaaaccaattgtgcatactcacaacatgtttatgacctttctttgcaaacatggaagaagcaaagaagctgcaggaatttttgataccatggctatgaagggcctgaaacataacaacgtttcatatgctattctccttcacgggtatgccaccgaaggatgcttagttgatatgattaatctcttcaattcaatggaaagatactgcattctacctgactgtcgtatcttcaacatactgattaatgcacatgctaaatctgggaagcttgataaggccatgcttatcttcaatgaaatgcagaaacaaggagtgagtccaaatgcagtcacatattcaaccataatacatgcattttgcaaaaagggtaggttggacgatgctgtgataaagtttaatcagatgattgatacaggagtacgacagggcacagctgtttatcgttccctaatccagggtttttgtacacacggcgatttggtgaaagcaaaggaattgcttactgaaatgatgaacaaaggtatgcttcctcctgatattgcattcttcaattcaatcatgcagaacctttgcacagaaggaagggtaatagaagcacgggatgtccttggcttgatagcgcacataggtatgaggcctgatgtttgcacatttaatatactgatcggtggatactgcctagtcggcaagatggaacatgcctcaaaaatatttgatgatatgatgtcatatggcttagaaccttctaatattacgtatggtatacttattaatggctattgcaaaaatagaaggattgatgacgggcttattctgttcaaagagatgctgcacaagggacttaaacctacaacttttaattataacgtcatactggatggattatttctggctggacgaactgttgctgcaaaggaaaagtttgatgagatggttgaatctggagtaagtgtgtgcattggtacatattcgatagttcttggtggactttgtagaaataattgtagcggcgaagcaatcacgctattccagaaattaagcacaatggatgtgaaattcaatattataattgtcaatataatgattgatgctttctacaaggttcagcgaaaccaagaagccaaggatttgtttgctgcagtatcagccaatggtttggtagctaatgtctttacctacaccataatgatgaaaaatcttataaaagaagggtcagtggaagaagctgacgatctctttttatcaatggagaagagcagctgtactgctgactcttatatgttaaatcttatcgtcagaatgttactgggaaaaggagagatagtcaaggctgggaattatatatctaaaattgatgcaaagagctactcacttgaagctaaaactgtttcgctgcttatctctctcttttcagggaaagggaaatatagagaacacataggattgctccctgcaaagtatcggtttcgtgaagaagcagctacagttgtg

SEQ ID NO: 1834 - DNA, 1515 bp, Triticum aestivum
atgtcgccgctccgcctccatgcccgccgctcctactccacctcgcatcccccacgcagccagggctgggatccccacgccgccttcgcagctgccacggagcgcgcgcgatctggcaacctcacctcggaggacgcacacaagctgttcgaccaattgctcctgcaggctaatccggtcaacatgcgccttcccaacgaccttctcaccgccctggctcgcgcgcctgcgtccgcagcctgcagcaacggccccgcccttgccctcgccctcttcagccgtttgtcccaaggtgcccgccaacgggtggtgcagccaacggcctgcacctacggcatcctcatggactgctgctgccgcgcaaaccgccaagatctggcgctcgccttcttcgcccgtctcctcaggacgggactcaaggcaggcgtcatagaagtcaacactcttctcaagggactctgccgcgcaaagtgggctgatgaggctctggacattctgcttcacaggatgcctgagctaggctgcacccccaacgtggtggcatataacacggtcatccatggcttcttccaagaaggccaagcaggcaaggcgtgcagcttgttccatgaaatggcgcagcagggcgttgcgcctagtttggtgacatataactcggttattgatgcgctgtgcaaggccagagccatggacaaggcagagtatttccttcgtcagatggttgatgatggtgtcatacctgataatgtgacatataatagcctcatccatggatattcctcttcaggccactggaaggaggcagttagggtattcaaagagatgacaagtcggagggttaaaccaaatgtgcatactcacaacatgtttatgacctttctttgcaaacatggaagaagcaaagaagctgcaggaatttttgataccatggctatgaagggcctgaaacataacaacgtttcatatgctattctccttcacgggtatgccaccgaaggatgcttagttgatatgattaatctcttcaattcaatggaaagatactgcattctacctgactgtcgtatcttcaacatactgattcatgcacatgctaaatctgggaagcttgataaggccatgcttatcttcaatgaaatgcagaaacaaggagtgagtccaaatgcagtcacatattcaaccataatacatgcattttgcaaaaagggtaggttggacgatgctgtgataaagtttaatcagatgattgatacaggagtacgacagggcacagctgtttatcgttccctaatccagggtttttgtacacacggcgatttggtgaaagcaaaggaattgcttactgaaatgatgaacaaaggtatgcttcctcctgatattgcattcttcaattcaatcatgcagaacctttgcacagaaggaagggtaatagaagcacgggatgtccttggcttgatagcgcacataggtatgaggcctgatgtttgcacatttaatatactggtggatactgcc

SEQ ID NO: 1835 - DNA, 2355 bp, Triticum aestivum; identical to SEQ ID NO: 1833

SEQ ID NO: 1836 - DNA, 2007 bp, Triticum aestivum
atgaggtcgtcgccagcaccctcctcaagtgcctcttctgtgcaaaacgggcagatgaagctgttgaacgtgctgcttcataggacgtccgtcctcggctgtgtgcctaattccttctcatacaacatagttctaaagagtttatgtgacgacagcaggagccagcaagcactcggcctgctccaggtgatggcaaagggagatgattgctcccccggcgttctgtcatatagcacgctcatccacggcttctttaaggaaggcgaagtaggcaaggcatgcaatctattccatgaaatgatgcggcaaggggttgtgcctgatgtggtgacgtatagctcgattattgatgcactgtgcaaggctggagcaatggacaaggcagagttgttccttcggcagatggttgataacagtgttcgaccggatacggtgacatatactagcatgatccatggatattccactttgggccggtggaaagaggcgactaaaatgttcagagaaatgacaagcaggggccttataccaaatattgtcacttggaactcattcatggcctccctttgcaagcatggaaaaagcaaagaagctgcagaaattttcttttccatggctgcaaggggccacaagcctgatatcatctcctacactattcttcttcatgggtatgccaatgaaggaagctttgctgatatgatgaatctctttaattcaatggtaggcgacggtattgtagccaactgccaagttttcaacatattaattgatgcatatgctaaacaaagaatgatggatgaagctatgatcatacttaataaaatgcggggacaaggactgagtccggatgtattcacctattcaactctagtatctgcactttgcaaaatggttagactggctgatgctatgggtaagttcagtcagatgattggtaggggagtacaaccgaacacagttgtttaccactccgtagttcagggcttatgcacacatggtgttttggtaaaagcaaaggagttggttaatgaaatgatgaataaaggtatgcttcgtccaaacattgcattcttcaattcaataatggacaacctatgcaatgaaggaagggttgtggatgcacaccatatctttgacttgattacagacataggtgagaaacctgatgtcattacatttagtacgctaattgacggatattgcttagtcggtgagatggagaaagcatgcggagtacttgatgccatggtatcagctggcattgagcccgatgtcattacgtataacacacttgtcagtggatactgtaaaagtggaaggattgatgatgggttgaatctgttcagagaaatgttccatatggaagttaaacctacaactgttacatataacatcatactggatggattatttcatgctgggagaacagttgctgcaaagaaaatgctccatgagatgatcggaagtggaacacctgtgagcatgcatacatacgacatatttattagaggactttgtagaaatgattgcaccgatgaagcaatcgcccttttccaaaaattaggtgcactgaatgtgaagttcgatattgcaatactcaattccatgattaatgcaatgtacaaggttcagagaagagaagaagctaacaagttgtttgctgctatatcaaccagtgggttggtacctaatgcttccacgtatggaatcatgataagaaatcttctaaaagagggatcagtggaagaagctgaagatatgttttcatcaatggagaagagtgattgtgctctcagctctcgtcttataaatgatatcattagaatgttattggaaaagggggagatagtcaaggccggagaatacatgtctaaagttgatgggaagagcatctcgcttgaagcttcaactagttcgttgttgttgtctctcttttcagggaaagggaaatatcgggaacaaatacaattgctccctgcaaagtaccaatttttcgatggaaccatt

SEQ ID NO: 1837 - DNA, 2007 bp, Triticum aestivum; identical to SEQ ID NO: 1836

SEQ ID NO: 1838 - DNA, 2436 bp, Triticum aestivum
atgtcctgcctccacctcctccgccgtcgcacctcctccttcactcccacctcgccgccctcacgctcctggtctccgcacgccgcctttgccgctgccacagagcgcgtccgcgccgggacgctcaccccacaagacgcacaccacctgttcgaccaattgctgcggcagtccactccggtccccgggcaagccctgaacggcttcctcgccggtcttgcccgtgcgcgagacaccgacgcctgcagagacggcccctcccttgccctcacgctcttcaaccgcgtatgccgagaagaagccggccggcgggtggcgccgcccacaatctacacctacggcatcctgatgaactgctgctgccacgtgcgtcgtccagacctagggcttgcctatttcggccgcctcctaaggaccggcctcaatacaaatgaggtcgtcgccagcaccctcctcaagtgcctctgctgtgcaaaacgggcagatgaagctgtgaacgtgctgcttcataggacgtccgtcctcggctgtgtgcctaattccttctcatacaacatagttctaaagagtttatgtgacgacagcaggagccagcaagcactcggcctgctccaggtgatggcaaagggagatgattgctcccccggcgttctgtcatatagaacgctcatccacggcttctttaaggaaggcgaagtaggcaaggcatgcaatctattccatgaaatgatgcggcaaggggttgtgcctgatgtggtgacgtatagctcgattattgatgcactgtgcaaggctggagcaatggacaaggcagagttgttccttcggcagatggttgataacagtgttcgaccggatacggtgacatatactagcatgatccatggatattccactttgggccggtggaaagaggcgactaaaatgttcagagaaatgacaagcaggggccttataccaaatattgtcacttggaactcattcatggcctccctttgcaagcatggaaaaagcaaagaagctgcagaaattttcttttccatggctgcaaggggccacaagcctgatatcatctcctacactattcttcttcatgggtatgccaatgaaggaagctttgctgatatgatgaatctctttaattcaatggtaggcgacggtattgtagccaactgccaagttttcaacatattaattgatgcatatgctaaacaaggaatgatggatgaagctatgatcatacttaataaaatgcggggacaaggactgagtccggatgtattcacctattcaactctagtatctgcactttgcaaaatgggtagactggctgatgctatgggtaagttcagtcagatgattggtaggggagtacaaccgaacacagttgtttaccactccctagttcagggcttatgtacacatggtgttttggtaaaagcaaaggagttggttaatgaaatgatgaataaaggtatgcttcgtccaaacattgcattcttcaattcaataatggacaacctatgcaatgaaggaagggttgtggatgcacaccatatctttgacttggttacagacataggtgagaaacctgatgtcattacatttactacgctaattgacggatattgcttagtcggtgagatggagaaagcatgcggagtacttgatgccatggtatcagctggcattgagcccgatgtcattacgtataacacacttgtcagtggatactgtaaaagtggaaggattgatgatgggttgaatctgttcagagaaatgtcccatatggaagttaaacctacaactgttacatataacatcatactggatggattatttcatgctgggagaacagttgctgcaaagaaaatgctccatgagatgatcggaagtggaacacctgtgagcatgcatacatacgacatatttattagaggactttgtagaaatgattgcaccaatgaagcaatcgcccttttccaaaaattaggtgcactgaatgtgaagttcgatattgcaatactcaattccatgattaatgcaatgtacaaggttcagagaagagaagaagctaacaagttgtttgctgctatatcaaccactgggttggtacctaatgcttccacgtatggaatcatgataagaaatcttctaaaagagggatcagtggaagaagctgaagatatgttttcatcaatggagaagagtgattgtgctctcagctctcgtcttataaatgatatcattagaatgttattggaaaagggggagatagtcaaggccggagaatacatgtctaaagttgatgggaagagcatctcgcttgaagcttcaactagttcgttgttgttgtctctcttttcagggaaagggaaatatcgggaacaaatacaattgctccctgcaaagtaccaatttttcgatggaaccatt

SEQ ID NO: 1839 - DNA, 2007 bp, Triticum aestivum; identical to SEQ ID NO: 1836

SEQ ID NO: 1840 - DNA, 2436 bp, Triticum aestivum; identical to SEQ ID NO: 1838

SEQ ID NO: 1841 - DNA, 2436 bp, Triticum aestivum; identical to SEQ ID NO: 1838

SEQ ID NO: 1842 - DNA, 2364 bp, Triticum aestivum
atgcctcgcttctccaccaccacgccaatgtcgccaccacgcctccgcctccgactcggcgcccgccactcctcctccacctctcatccctcatgcatctgggatccccacgccgccttcgccgccgcgacgcagcgggcgcgctctggcaagctcaccacggaggacgcacaccacctgttcgacgaattgctgcggcagggcaatcctgtccaggagcgtcccttgactaactttctggctgccctcgcccgtgcgcccgcgtccgcatcctgcagcgacggccccgccctggccgtcgccctttttggccgtttgtcccgaggcgctggacgaggggtggcacagccaaatgtcttcacctatggcgtcctaatggactgctgctgccgtgcgcgcttcccagatttggcgctcgccttctttggccgtctcctcaggacgggcctgaaggcagaccaagtcgttttcagcaccctcctcaagggactctgccacgcaaagcgctcagatgaggctctggacgtgctgctgcacaggatgcctgagctgggctgcacccccgacgtggtggtgtataataccgtcatccatggcttctttagggaaggccaagcaggcaaggcgtgcgatctgttccatggaatggcgcagcagggcgttatgcctgatgtggtgacatataactcggttatcgatgcactgtgcaaggccagagcaatggacaaggcagagtatttccttcgtcagatggttgatgatggtgttgtacctgataatgtgacatatagtagcctcatccatggatattcctcttcaggccactggaaggaggctgttagggtattcaaagagatgacaagtcggagggttacaccagatgtgcatacttacaacatgtttatgacctttctttgcaaacatggaagaagcaaagaagctgcaggtatttttgataccatggctatgaagggcctgaaacctgacaacatttcatatgctattcgccttcatgggtatgccaccgaaggatgcttagttgatatgattaatctcttcaattcaatggaaagagactgcattctacctgactgtcgtatcttcagcatactgattaatgcatatgctaaatctggaaagcttgataaggctatgcttatcttcaataaaatgcagaaacaaggagtgagtccaaatgcagtcacatattcaactgtaatagatgcattttgcaaaaagggtcagttggacgatgctatgataaagtttaatcagatgattgatacaggagtacgacagggcacagctgtttatggttctctaatccagggtttttgtacacacggcgatttggtgaaagcaaaggaattgcttactgaaatgatgaacaaaggtatacctcctcctgatattaagttcttccattcaatcatgcagaacctttgcacagaaggaagggtaatagaagcacgggatgtctttggcttgatggcgcacataggtatcaggcctaatgtttgcacatttaatatactgatcggtggatactgcctagtcggcaagatggaggatgcctcaaaaatatttgatgatatgatgtcatatggtttagaaccttctaatattacgtatggtatacttattaatggctattgcaaaaacgaaaggattgatgatgggctgattctgttcaaagaaatgttgcgcaagggagttaaaccttcaacttttaattataacatcatactggatggattatttctggctggacgaactgttgctgcaaaggaaaagtttgatgagatggttgaatctggagtaagtgtgtgcattgatacatattcgatagttcttggtggactttgtagaaataattgtagcggcgaagcaatcatgctattccagaaattaagcacaatggatgtgaaattcaatattataattgtcaatataatgattgatgccttctacagggttcagcgaaaccaagaagccaaggatttgtttgctgcagtatcagcgaatggtttggtagctaatgtctttacctacaccataatgatgaaaaatcttataaaagaagggtcagtggaagaagctgacgatctctttttatcaatggagaagagcggctgtactgctgactcttatatgttaaatcttatcgtcagaatgttacttgaaaaaggagagctagtcaaggctgggaattatatgtctaaagttgatgcaaagagctactcacttgaagctgaaaccgtttcgctgcttatctctctcttttcagggaaagggaaatatagagaacacataggattgctccctacaaagtatcagtttcgtgaagaagcggccacagttgaa

SEQ ID NO: 1843 - DNA, 1863 bp, Triticum aestivum
atgattaaaagggatgtagataagataactgaaggttgccgcctagcacattcacattggtacaacttggaaaagcacagccccgtcgtcctgctcccagttgagttcgcgacctacacaccggccatgccccgcttctcctccaccacgccaatgtcgccaccccgcctccgcctccgactccgactctgcgcccgccactcctcctccacctctcatccctcacgcatctgggatccccacgccgccttcgccgccgccacggagcgtgcgcgttcaggcaacctcaccccggaggacgcacaccacctgttcgacgaattgctgcggcagggcaatcctgtccaggagcgtcccttgactaactttctggctgccctcgcccgtgcgcccgcgtccgcatcctgcagcgacggccccgccctggccgtcgccctttttggccgtttgtcccgaggcgctggacgaggggtggcacagccaaatgtcttcacctatggcgtcctaatggactgctgctgccgtgcgcgcttcccagatttggcgctcgccttctttggccgtctcctcaggacgggcctgaaggcagaccaagtcgttttcagcaccctcctcaagggactctgccacgcaaagcgctcagatgaggctctggacgtgctgctgcacaggatgcctgagctgggctgcactccctatgtggtggcgtataacaccgtcatccatggcttctttagggaaggccaagcaggcaaggcgtgcgatctgttccatggaatggcgcagcagggcgttatgcctgatgtggtgacatataactcggttatcgatgcgctgtgcaaggccagagcaatggacaaggcagagtatttccttcgtcagatggttgatgatggtgttgtacctgataatgtgacatatagtagcctcatccatggatattcctcttcaggccactggaaggaggctgttagggtattcaaagagatgacaagtcggagggttacaccagatgtgcatacttacaacatgtttatgacctttctttgcaaacatggaagaagcaaagaagctgcaggtatttttgataccatggctatgaagggcctgaaacctgacaacatttcatatgctattcgccttcatgggtatgccaccgaaggatgcttagttgatatgattaatctcttcaattcaatggaaagggactgcattctacctgactgtcgtatcttcagcatactgattaatgcatatgctaaatctgggaagcttgataaggctatgcttatcttcaataaaatgcagaaacaaggagtgagtccaaatgcagtcacatattcaactgtaatagatgcattttgcaaaaagggtcagttggacgatgctatgataaagtttaatcagatgattgatacaggagtacgacagggcacagctgtttatggttctctaatccagggtttttgtacacacggcgatttggtgaaagcaaaggaattgcttactgaaatgatgaacaaaggtatacctcctcctgatattaagttcttccattcaatcatgcagaacctttgcacagaaggaagggtaatagaagcacgggatgtccttggcttgatggcgcacataggtatcaggcctaatgtttgcacatttaatatactgatcggtggatactgcctagtcggcaagatggaggatgcctcaaaaatatttgatgatatgatgtcatatggtttagaaccttctaatattacgtatggtatacttattaatggctattgcaaaaacgaaaggattgatgatgggctgattctgttcaaagaaatgttgcgcaagggagttaaaccttccaagttt

SEQ ID NO: 1844 - DNA, 2376 bp, Triticum aestivum
atgccccgcttctcctcctccacgccaatgtcgccaccccgcctccgcctccgactccgactccgactctgcgcccgccactcctcctccacctctcatccctcacgcatctgggatccccacgccgccttcgccgccgcgacgcagcgggcgcgctctggcaagctcaccacggaggacgcacaccacctgttcgacgaattgctgcggcagggcaatcctgtccaggagcgtcccttgactaactttctggctgccctcgcccgtgcgcccgcgtccgcatcctgcagcgacggccccgccctggccgtcgccctttttggccgtttgtcccgaggcgctggacgaggggtggcacagccaaatgtcttcacctatggcgtcctaatggactgctgctgccgtgcgcgcttcccagatttggcgctcgccttcttgggccgtctcctcaggacgggcctgaaggcagaccaagtcgttttcagcaccctcctcaagggactctgccacgcaaagcgctcagatgaggctctggacgtgctgcttcacaggatgcctgagcagggctgcactccctatgtggtggcgtataacaccgtcatccatggcttctttagggaaggccaagcaggcaaggcgtgcgatctgttccatggaatggcgcagcagggcgttatgcctgatgtggtgacatataactcggttatcgatgcgctgtgcaaggccagagcaatggacaaggcagagtatttccttcgtcagatggttgatgatggtgttgtacctgataatgtgacatatagtagcctcatccatggatattcctcttcaggccactggaaggaggctgttagggtattcaaagagatgacaagtcggagggttacaccagatgtgcatacttacaacatgtttatgacctttctttgcaaacatggaagaagcaaagaagctgcaggtatttttgataccatggctatgaagggcctgaaacctgacaacatttcatatgctattcgccttcatgggtatgccaccgaaggatgcttagttgatatgattaatctcttcaattcaatggaaagggactgcattctacctgactgtcgtatcttcagcatactgattaatgcatatgctaaatctgggaagcttgataaggctatgcttatcttcaataaaatgcagaaacaaggagtgagtccaaatgcagtcacatattcaactgtaatagatgcattttgcaaaaagggtcagttggacgatgctatgataaagtttaatcagatgattgatacaggagtacgacagggcacagctgtttatggttctctaatccagggtttttgtacacacggcgatttggtgaaagcaaaggaattgcttactgaaatgatgaacaaaggtatacctcctcctgatattaagttcttccattcaatcatgcagaacctttgcacagaaggaagggtaatagaagcacgggatgtccttggcttgatggcgcacataggtatcaggcctaatgtttgcacatttaatatactgatcggtggatactgcctagtcggcaagatggaggatgcctcaaaaatatttgatgatatgatgtcatatggtttagaaccttctaatattacgtatggtatacttattaatggctattgcaaaaacgaaaggattgatgatgggctgattctgttcaaagaaatgttgcgcaagggagttaaaccttcaacttttaattataacatcatactggatggattatttctggctggacgaactgttgctgcaaaggaaaagtttgatgagatggttgaatctggagtaagtgtgtgcattgatacatattcgatagttcttggtggactttgtagaaataattgtagcggcgaagcaatcatgctattccagaaattaagcacaatggatgtgaaattcaatattataattgtcaatataatgattgatgccttctacagggttcagcgaaaccaagaagccaaggatttgtttgctgcagtatcagcgaatggtttggtagctaatgtctttacctacaccataatgatgaaaaatcttataaaagaagggtcagtggaagaagctgacgatctctttttatcaatggagaagagcggctgtactgctgactcttatatgttaaatcttatcgtcagaatgttacttgaaaaaggagagctagtcaaggctgggaattatatgtctaaagttgatgcaaagagctactcacttgaagctgaaaccgtttcgctgcttatctctctcttttcagggaaagggaaatatagagaacacataggattgctccctacaaagtatcagtttcgtgaagaagcggccacagttgaa

SEQ ID NO: 1845 - DNA, 2352 bp, Triticum aestivum
atgcctcgcctctcctccaccacgcccatgtcgccactccgcctccgcgcccgccactcctcctccacctctcatccctcacgcatctgggatccccacaccgccttcgccaccgccacggagcgtgcgcgttcaggcaacctcaccccggaggacgcacaccacctgttcgacgaattgctgcggcaggccaatcctgtccaggagcgccccctcaacaaccttcttgccgccctcgcccgcgctccggcgtccgcggcgtgcagcgatggccctgcactcgcagtcaacctcttcagccgcatatccgaaggcgcccgccgacgtgtggcgcacccaacggcctgcacctacggcatcctcatggactgctgctgccgcgcaaaccgccaggatctggcgctcgccttcttcgcccgtctcctcaggacgggactcaaggcaggcgtcatagaagtcaacactcttctcaagggactctgccgcgcaaagcgggctgatgaggctctggacattctgcttcacaggatgcctgagctaggctgcacccccaacgtggtggcatataacacggtcatccatggcttctttagggaaggccaagtaggcaaggcgtgcaatctattccatgaaatgaggcagcagggcgttacacctgatgttgtgacatataactcggttattgatgcgttgtgcaaggccaaagcaatggacaaggcagagtatttccttggtcagatggttgatgatggtgtcgtatctgataatgtgacatataatagcctcatccatggatattcctcttcaggccactggaaggaggctgttagggtattcaaagagatgacaagtcggagggttacaccagatttgcatacttacaacatgtttatgacctttctttgcaaccatggaagaagcaaagaagctgcaggaatttttgattccatggctatgaagggcctgaaacctgacaacgtttcatatgctattcgccttcatgggtatgccaccgaaggatgcttagttgatatgattaatctcttcaattcaatggaaagagactgcattcttcctgactgtcgtatcttcagcatactgatttatgcatatgctaaatctgggaagcttgataaggctatgcttatcttcaatgaaatgcagaaacaaggagtgagtccaaatgcagtcacatattcaaccgtaatagatgcattttgcaaaaagggtcagttggacgatgctatgataaagtttaatcagatgattgatacaggagtacgacagggcacagctgtttatcgttccctaatccagggattttgtacacacggcgatttggtgaaagcaaaggaattgcttactgaaatgatgaacaaaggtatacctcctcctgatattaagttcttccattcaatcatgcagaacctatgcacagaaggaagggtaatagaagcacgggatatccttggcttgatagcacacataggtatgaggcctaatgtttgcacatttaatatactgattggtggatactgcctagtccgcaagatggcagatgcatcgaaagtatttgatgatatggtgtcatatggtttagaaccttgtaactttacgtatggtatacttattaatggctattgcaaaaatagaaggattgatgacgggcttattctgttcaaagagatgctgcacaagggacttaaacctacaactgttaattataacgtcatactggatggattatttctggctggacaaactgttgctgcaaaagagaagtttgatgagatggttgaatctggagtaagtgtgtgcattgatacatactctatagttcttggtggactttgtagaaatagctgcagtagcgaagcgatcaccctgttccgaaaattaagtgcaatgaatgtgaaatttgatattaaaattgtcaatatcattattggtgcattctacagggtcaagagaaaccaagaggctaaggatttgtttgctgctataccagccaatggcttggttcctaatgctgttacctacaccataatgatgacaaatcttataaaagaaggttcagtggaagaagccgacaatctttttttatcaatggagaagagcggctctactgcaaactcttggatgttaaatcatattatcagaaggttactggaaagaggagagatagtcaaggctggaaattatatgtctaaagttgatgtaaagagctactcacttgaagctaaaactgtttcactgctgatctctctgttttcaagggaaggggaatatagagaccacatcaaattgctccctataaagtatcagtttctggaaaaaccagccacagttgaa

SEQ ID NO: 1846 - DNA, 2352 bp, Triticum aestivum; identical to SEQ ID NO: 1845

SEQ ID NO: 1847 - DNA, 2364 bp, Triticum aestivum
atgcctcgtttctcctccaccacgtcaatgtcgtcactccgcctccgcctccacgcccgccactcctcctccgcctctcaaccctcacacagccagggctgggatccccacgccgccttcgccgccgccacggagcgtgcgcgctctggcagcctcaccccggtggacgcacaccacctgttcgacgaattgctccggcagaccaatcctgtccaggagcaacccctcaacaaccttctcgccgccctcgcccgcgctccggcgtccaacgcctgcagagacggccctgcactcgcggtcgccctcttcagccgcatatcccaaggcgcccgcctacgggtggcgcagccaacggcctgcacctacggcatcctcatggactgctgctgtcgtgcacatcgcctggatctggcgtttgccttcttcggccgtctcctcaggacgggactgaaggcaggcgtcattcaactctgcactcttctcaagggcctttgccgcgcaaagcgggctgatgaggccatggacgtgctgcttcataggatgcctgagctgggctgcacccccaacgtggtggcctataccacggtcatccacggcttcttgaaggaaggccaagtaggcaaggcatgcaatctattccatggaatggcgcagcagggcgttgcacctaatgtggtgacatataactcggttatcgatgcgctatgcaaggccagggccatgggaaaggcagagatggtccttggtcaaatggttgttaatggtgttggaccgagtaacgtgacatataatactctcatccatggatattcctcttcaggtcatcagaaggaggcagttagggtgctgaaagaaatgagaagtcagggtatcataccagatgtttttacttgcagctcgctcatggcctccctttgcaacaacggaaaaagcaaagaagctgaagaaattcttcactccatggtcatgaagggcctgaaacctgacatcgtctcgtacagtactctgcttcacgggtatgccaccgaaggatgcttagttggtatgactaatctcttcaattcaatgactagatatggcattcgccctaacagtcatgcttttaacatactgattaatgtatgtgctaaatctggcatgatggatgaggctatgcttatatttaaagaaatgcagaagcgaggagtgagtccaaatctagtcacctattcaactgtaatacatgcattttgcaaaatgggtagcttggacattgctatggacaaatttaaccagatggttgatataggagtacgaccggatgcaattgtttatcgttccctaatccatggtttttgtacacatggggatttagtgaaaccaaaggaattggttactgaaatgaggaacaaaggtatgcgtcctcctgatattaagttcttccattcaataatgcagaacctatgcacggaaggaagggtaatagaagcacgggatatcctcgacttgatagtgcgcattggtatgaggcctgatgttttcatatttaatatactgatcggtggatactgcctagtccgcaagatggcagatgcatcaaaaatatttgatgatatggtgtcatatggtttagaaccttcaaatattacgtatggtatacttattaatggctattgcaaaaacagaaggattgatgaggggctgattctattcaaagaaatgttgtgcaagggacttaaacctacaacttttaactataacgtcatactggatggactatttctggctggacgaactgttgctgcgaaggagaagtttgatgagatggttgaatctggagtaagtgtgtgcatcgatacttactctatatttcttgctggactttgcagaaataattgctttagtgaagtaatcatgctgttccagaaattaagcgcaatgaacatgaaattcaatattagaattgtcaatatcatgattgatgccttctacaaggttcggcgaaaccatgaagctaaggatttgtttgccgcaataccatccaatggcttggtagctaatgttgttacctacagcataatgatgacaaatctgataaaagaaggttcagtggaagaagctgacactctctttttatcaatggagaagagcggctgtactgcaaactcttggatgttaaatcatattatcagaaggttactggaaagaggagagatagtcaaggctggaaattatatgtcgaaagttgatgcaaagagctactcacttgaagctaaaactgttttgctgctgatctctctcttttcagggaaagggaaatatagagaacacataaaattgctccctatgaagtatcagtttctcgaagaaccagacacagttgaa

SEQ ID NO: 1848 - DNA, 2364 bp, Triticum aestivum
atgcctcgtttctcctccaccacgtcaatgtcgtcactccgcctccgcctccacgcccgccactcctcctccgcctctcaaccctcacacagccagggctgggatccccacgccgccttcgccgccgccacggagcgtgcgcgctctggcagcctcaccccggtggacgcacaccacctgttcgacgaattgctccggcagaccaatcctgtccaggagcaacccctcaacaaccttctcgccgccctcgcccgcgctccggcgtccaacgcctgcagagacggccctgcactcgcggtcgccctcttcagccgcatatcccaaggcgcccgcctacgggtggcgcagccaacggcctgcacctacggcatcctcatggactgctgctgtcgtgcacatcgcctggatctggcgtttgccttcttcggccgtctcctcaggacgggactgaaggcaggcgtcattcaactctgcactcttctcaagggcctttgccgcgcaaagcgggctgatgaggccatggacgtgctgcttcataggatgcctgagctgggctgcacccccaacgtggtggcctataccacggtcatccacggcttcttgaaggaaggccaagtaggcaaggcatgcaatctattccatggaatggcgcagcagggcgttgcacctaatgtggtgacatataactcggttatcgatgcgctatgcaaggccagggccatgggaaaggcagagatggtccttggtcaaatggttgttaatggtgttggaccgagtaacgtgacatataatactctcatccatggatattcctcttcaggtcatcagaaggaggcagttagggtgctgaaagaaatgagaagtcagggtatcataccagatgtttttacttgcagctcgctcatggcctccctttgcaacaacggaaaaagcaaagaagctgaagaaattcttcactccatggtcatgaagggcctgaaacctgacatcgtctcgtacagtactctgcttcacgggtatgccaccgaaggatgcttagttggtatgactaatctcttcaattcaatgactagatatggcattcgccctaacagtcatgcttttaacatactgattaatgtatgtgctaaatctggcatgatggatgaggctatgcttatatttaaagaaatgcagaagcgaggagtgagtccaaatctagtcacctattcaactgtaatacatgcattttgcaaaatgggtagcttggacattgctatggacaaatttaaccagatggttgatataggagtacgaccggatgcaattgtttatcgttccctaatccatggtttttgtacacatggggatttagtgaaaccaaaggaattggttactgaaatgaggaacaaaggtatgcgtcctcctgatattaagttcttccattcaataatgcagaacctatgcacggaaggaagggtaatagaagcacgggatatcctcgacttgatagtgcgcattggtatgaggcctgatgttttcatatttaatatactgatcggtggatactgcctagtccgcaagatggcagatgcatcaaaaatatttgatgatttggtgtcatatggtttagaaccttcaaatattacgtatggtatacttattaatggctattgcaaaaacagaaggattgatgaggggctgattctattcaaagaaatgttgtgcaagggacttaaacctacaacttttaactataacgtcatactggatggactatttctggctggacgaactgttgctgcgaaggagaagtttgatgagatggttgaatctggagtaagtgtgtgcattgatacttactctatatttcttgctggactttgcagaaataattgctttagtgaagtaatcatgctgttccagaaattaagcgcaatgaacatgaaattcaatattagaattgtcaatatcatgattgatgccttctacaaggttcggcgaaaccatgaagctaaggatttgtttgccgcaataccatccaatggcttggtagctaatgttgttacctacagcataatgatgacaaatctgataaaagaaggttcagtggaagaagctgacactctctttttatcaatggagaagagcggctgtactgcaaactcttggatgttaaatcatattatcagaaggttactggaaagaggagagatagtcaaggctggaaattatatgtcgaaagttgatgcaaagagctactcacttgaagctaaaactgttttgctgctgatctctctcttttcagggaaagggaaatatagagaacacataaaattactccctatgaagtatcagtttctcgaagaaccagacacagttgaa

SEQ ID NO: 1849 - DNA, 2370 bp, Triticum aestivum
atgcctcgcttctcttccaccacgccaatggcgtcactccgcctccgcctccgcctccacgcccgcaactactcatccgcctctcaaccctcacacggccagggctgggatccccacgccgccttcgccgccgccacggagcgtgcccgctctggcagcctcaccccggcggacgcacaccacctgttcgacgaattgctgcggcaggccaatcctgtccaggagcgccccctcaacaaccttctcgccgccatcgcccgcgctccggcgtccaacgcctgcagaaacggccctgcactcgcggtcgccctcttcagccgcatatcccaaggcgcccgcctatgggtggtgcagccaacggcttgcacctacggcatcctcatggactgctgctgccgtgcacatcgcctggatctggcgtttgccttcttcggccgtctcctcaggacgggactgaaggcaggcgtcattcaactctgcactcttctcaagggcctttgccgcgcagagcgggctgatgaggccatggacgtgctgcttcataggatgcctgagctgggctgcacccccaacgtggtggcctataccacggtcatccacggcttcttgaaggaaggccaagtaggcaaggcatgcaatctattccatggaatggcgcagcagggcgttgcacctaatgtggtgacatataactcgtttatcgatgcgctatgcaaggccagggccatgggaaaggcagagatggtccttggtcaaatggttgttaatggtgttggacctagtaacgtgacatataatactctcatccatggatattcctcttcaggtcatcagaaggaggcagttagggtgctgaaagaaatgagaagtcagggtatcataccagatgtttttacttgcagctcgctcatggcctccctttgcaacaacggaaaaagcaaagaagctgaagaaattcttcactccatggtcatgaagggcctgaaacctgacatcgtctcgtacagtactctgcttcacgggtatgccaccgaaggatgcttagttggtatgactaatctcttcaattcaatgactagatatggcattcgccctaacagtcatgcttttaacatactgattaatgtatgtgctaaatctggcatgatggatgaggctatgcttatatttaaagaaatgcagaagcgaggagtgagtccaaatctagtcacctattcaactgtaatacatgcattttgcaaaatgggtagcttggacattgctatggacaaatttaaccagatggttgatataggagtacgaccggatgcaattgtttatcgttccctaatccatggtttttgtacacatggggatttagtgaaaccaaaggaattggttactgaaatgaggaacaaaggtatgcgtcctcctgatattaagttcttccattcaataatgcagaacctatgcacggaaggaagggtaatagaagcacgggatatcctcgacttgatagtgcgcattggtatgaggcctgatgttttcatatttaatatactgatcggtggatactgcctagtccgcaagatggcagatgcatcaaaaatatttgatgatatggtgtcatatggtttagaaccttcaaatattacgtatggtatacttattaatggctattgcaaaaacagaaggattgatgaggggctgattctattcaaagaaatgttgtgcaagggacttaaacctacaacttttaactataacgtcatactggatggactatttctggctggacgaactgttgctgcgaaggagaagtttgatgagatggttgaatctggagtaagtgtgtgcatcgatacttactctatatttcttgctggactttgcagaaataattgctttagtgaagtaatcatgctgttccagaaattaagcgcaatgaacatgaaattcaatattagaattgtcaatatcatgattgatgccttctacaaggttcggcgaaaccatgaagctaaggatttgtttgccgcaataccatccaatggcttggtagctaatgttgttacctacagcataatgatgacaaatctgataaaagaaggttcagtggaagaagctgacactctctttttatcaatggagaagagcggctgtactgcaaactcttggatgttaaatcatattatcagaaggttactggaaagaggagagatagtcaaggctggaaattatatgtcgaaagttgatgcaaagagctactcacttgaagctaaaactgttttgctgctgatctctctcttttcagggaaagggaaatatagagaacacataaaattgctccctatgaagtatcagtttctcgaagaaccagacacagttgaa

SEQ ID NO: 1850 - DNA, 2445 bp, Triticum aestivum
atgagtactagtagtagtacatgctcattggtacaacttggaaaagcactccactcgtcttgctcccggttccaccacgccatgcctcgcctctcctccaccacgccaatgtcgccaccccacctccgcctccgactcggcgcccgccactcctcctccacctctcatctctcacgcatctgggatccccacgccgccttcgccgcagccacggagcgtgtgcgctctggcagcctcaccccggcggacgcccaccacctgttcgacgaattgctccggcagaccaatcctgtccaggagcaacccctcaacaaccttctcgccgccctcgcccgcgctccggcgtccaacgcctgcagagacggccctgcactcgcggtcgccctcttcagccgcatatcccaaggcgcccgcctatgggtggtgcagccaacggcttgcacctacggcatcctcatggactgctgctgccgtgcacatcgcctggatctggcgtttgccttcttcggccgtctcctcaggacgggactgaaggcaggcgtcattcaactctgcactcttctcaagggcctttgccgcgcagagcgggctgatgaggccatggacgtgctgcttcataggatgcctgagctgggctgcacccccaacgtggtggcctataccacggtcatccacggcttcttgaaggaaggccaagtaggcaaggcatgcaatctattccatggaatggcgcagcagggcgttgcacctaatgtggtgacatataactcggttatcgatgcgctatgcaaggccagggccatgggaaaggcagagatggtccttggtcaaatggttgttaatggtgttggaccgagtaacgtgacatataatactctcatccatggatattcctcttcaggtcatcagaaggaggcagttagggtgctgaaagaaatgagaagtcagggtatcataccagatgtttttacttgcagctcgctcatggcctccctttgcaacaacggaaaaagcaaagaagctgaagaaattcttcactccatggtcatgaagggcctgaaacctgacatcgtctcgtacagtactctgcttcacgggtatgccaccgaaggatgcttagttggtatgactaatctcttcaattcaatgactagatatggcattcgccctaacagtcatgcttttaacatactgattaatgtatgtgctaaatctggcatgatggatgaggctatgcttatatttaaagaaatgcagaagcgaggagtgagtccaaatctagtcacctattcaactgtaatacatgcattttgcaaaatgggtagcttggacattgctatggacaaatttaaccagatggttgatataggagtacgaccggatgcaattgtttatcgttccctaatccatggtttttgtacacatggggatttagtgaaaccaaaggaattggttactgaaatgaggaacaaaggtatgcgtcctcctgatattaagttcttccattcaataatgcagaacctatgcacggaaggaagggtaatagaagcacgggatatcctcgacttgatagtgcgcattggtatgaggcctgatgttttcatatttaatatactgatcggtggatactgcctagtccgcaagatggcagatgcatcaaaaatatttgatgatatggtgtcatatggtttagaaccttcaaatattacgtatggtatacttattaatggctattgcaaaaacagaaggattgatgaggggctgattctattcaaagaaatgttgtgcaagggacttaaacctacaacttttaactataacgtcatactggatggactatttctggctggacgaactgttgctgcgaaggataagtttgatgagatggttgaatctggagtaagtgtgtgcatcgatacttactctatatttcttgctggactttgcagaaataattgctttagtgaagtaatcatgctgttccagaaattaagcgcaatgaacatgaaattcaatattagaattgtcaatatcatgattgatgccttctacaaggttcggcgaaaccaagaagctaaggatttgtttgccgcaataccatccaatggcttggtagctaatgttgttacctacagcataatgatgacaaatctgataaaagaaggttcagtggaagaagctgacactctctttttatcaatggagaagagtggctgtactgcaaactcttggatgttaaatcatattatcagaaggttactggaaagaggagagatagtcaaggctggaaattatatgtcgaaagttgatgcaaagagctactcacttgaagctaaaactgttttgctgctgatctctctcttttcagggaaagggaaatatagagaacacataaaattgctccctatgaagtatcagtttctcgaagaaccagacacagttgaa

SEQ ID NO: 1851 - DNA, 2376 bp, Triticum aestivum
atgcctcgcttctcctccaccacgcccatgtcgccactccgcctccgcctccgcctccgcctccgactcggcgcccgccactcctcctccacctcccattcctcacgcagctgggatccccactccgccttcgccgccgccgcggagcgtgcgcgctctggcaaccttaccccggaggacgcacaccacctgttcgacgaattgctccggcagggcaatcctatccaggaccgccccttgaacaaacttctctccgccctcgcccgtgctccggcgtccgcgacctgcagaaacggccctgcactcgcggtcgccctcttcagccgcatatcccaaggtgcccgccgacgtgtggcagagccaacggcctgcacctacggcatcctcatggactgctgctgccgcgcacaccgcctcgatctggtgttcgctttcttcggccgtctcctcaggacgggacttaaggcaggcgtcattcaagtttgcactcttctcaagggcctctgccgcgcaaagcgggctgatgaggctctcgacgtgctgcttcacaggatgcctgagctgggctgcactcccaacgtggtggcatataccacggtcatccacggcttctttaaggaaggccaagtaggcaaggcatgcaatctgttccatggaatggcgcagcagggtgttgcgcctaatttggtgacatataactcggttattgatgcgttgtgcaaggccaaagcaatggacaaggcagagtatttccttggtcagatggttgatgatggtgttgtacctgataatgtgacatataatagcctcatccatggatattcctcttcaggccactggaaggaggcagttagggtattcaaagagatgacaagtcggagggttacagcagatgtgcatacttacaacatgtttatgacctttctttgcaaacatggaagaagcaaagaagctgcaggaatttttgataccatggctatgaagggcctgaaacctgacaacgtttcatatgctattctccttcatgggtatgccactgaaggatgcttagttgatatgattaatctcttcaattcaatggaaagagattgtattctacctgactgtcgtatcttcaacatactgattaatgcatatgctaaatctgggaagcttgataaggctatgcttatcttcaatgaaatgcagaaacaaggagtgagtccaaatgcagtcacatattcaactgtaatagatgcattttgcaaaaagggtcagttggacgatgctatgataaagtttaatcagatgattgatacaggagtacgacagggcacagctatttatggttctctaatccagggtttttgtacacacggcgatttggtgaaagcaaaggaattggctactgaaatgatgaacaaaggtatacctcctcctgatattaagttcttccattcaatcatgcagaacctttgcacagaaggaagggtaatagaagcacgggatgtccttggcttgatagcgcacataggtatgaggcctaatgtttgcacatttaatatactgatcggtggatattgcctagtcggcaagatggaggatgcctcaaaaatatttgacgatatgatgtcatatggcttagaaccttctaatattacgtatggtatacttattaatggctattgcaaaaacgaaaggattaacgatgggctgattctgttcaaagaaatgttgcgcaagggacttaaacctacaacttttaattacaacgtcatactagatggattatttttggctggacgaactgttgctgcaaaggaaaagtttgatgagatggttgaatttggagtaagtgtgtgcattgatacatattcgatagttcttggtggactttgtagaaataattgtagcggcgaagcaatcacgctattccagaaattaagcacaatcgatgtgaaattcaatattacaattgtcaatataatgattgatgccttctacagggttcagcgaaaccaagaagccaaggatttgtttgctgcagtatcagccaatggtttggtagctaatgtctttacctacaccataatgatgaaaaatcttataaaagaagggtcagtggaagaagctgacgatctctttttatcaatggagaagagcggctgtactgctgactcttatatgttaaatcttatcgtcagaatgttactgggaaaaggagagatagtcaaggctgggaattatatatctaaaattgatgcaaagagctactcacttgaagctaaaactgtttcgctgcttatctctctcttttcagggaaagggaaatatagagaacacataggattgctccctgcaaagtatcggtttcgtgaagaagcagccacagttgtg

SEQ ID NO: 1852 - DNA, 804 bp, Triticum aestivum
atgcctcgcttctccgccgccacgcccatgtcgccactccgcctccgcctccgcctccgcgcccgccactcctcctccacctcccattcctcacgcagctgggatccccactccgccttcgccgccgccgcggagcgtgcgcgctctggcaacctcaccccggaggacgcacaccacctgttcgacgaattgctccggcagggcaatcctgtccaggaccgccccttgaacaaacttctctccgccctcgcccgtgctccggcgtccgcgacctgcagaaacggccctgcactcgcggtcgccctcttcagccgcatatcccaaggtgcccgccgacgtgtggcagagccaacggcctgcacctacggcatcctcatggactgctgctgccgcgcacaccgcctcgatctggtgttcgctttcttcggccgtctcctcaggacgggacttaaggcaggcgtcattcaagtttgcactcttctcaagggcctctgccgcgcaaagcgggctgatgaggctctcgacgtgctgcttcacaggatgcctgagctgggctgcactcccaacgtggtggcatataccacggtcatccacggcttctttaaggaaggccaagtaggcaaggcatgcaatctgttccatggaatggcgcagcagggcgttgcgcctaatttggtgacatataactcggttattgatgcgttgtgcaaggccaaagcaatggacaaggcagagtatttccttggtcagatggttgatgatggtgtcgtacctgataatgtgacatataatagcctcatccat

SEQ ID NO: 1853 - DNA, 2376 bp, Triticum aestivum; identical to SEQ ID NO: 1851

SEQ ID NO: 1854 - DNA, 2370 bp, Triticum aestivum
atgcctcgcttctcctccaccacgcccatgtcgccactccgcctccgcctccgcctccgactcggcgcccgccactcctcctccacctcccattcctcacgcagctgggatccccactccgccttcgctgccaccgcggagcgtgcgcgctctggcaacctcaccccggaggacgcacaccacctgttcgacgaattgctccggcagggcaatcctatccaggaccgccccttgaacaaacttctctccgccctcgcccgtgctccggcgtccgcgacctgcagaaacggccctgcactcgcggtcgccctcttcagccgcatatcccaaggtgcccgccgacgtgtggcagagccaacggcctgcacctacggcatcctcatggactgctgctgccgcgcacaccgcctcgatctggtgttcgctttcttcggccgtctcctcaggacgggacttaaggcaggcgtcattcaagtttgcactcttctcaagggcctctgccgcgcaaagcgggctgatgaggctctcgacgtgctgcttcacaggatgcctgagctgggctgcactcccaacgtggtggcatataccacggtcatccacggcttctttaaggaaggccaagtaggcaaggcatgcaatctgttccatggaatggcgcagcagggtgttgcgcctaatttggtgacatataactcggttattgatgcgttgtgcaaggccaaagcaatggacaaggcagagtatttccttggtcagatggttgatgatggtgttgtacctgataatgtgacatataatagcctcatccatggatattcctcttcaggccactggaaggaggcagttagggtattcaaagagatgacaagtcggagggttacagcagatgtgcatacttacaacatgtttatgacctttctttgcaaacatggaagaagcaaagaagctgcaggaatttttgataccatggctatgaagggcctgaaacctgacaacgtttcatatgctattctccttcatgggtatgccactgaaggatgcttagttgatatgattaatctcttcaattcaatggaaagagattgtattctacctgactgtcgtatcttcaacatactgattaatgcatatgctaaatctgggaagcttgataaggctatgcttatcttcaatgaaatgcagaaacaaggagtgagtccaaatgcagtcacatattcaactgtaatagatgcattttgcaaaaagggtcagttggacgatgctatgataaagtttaatcagatgattgatacaggagtacgacagggcacagctatttatggttctctaatccagggtttttgtacacacggcgatttggtgaaagcaaaggaattggctactgaaatgatgaacaaaggtatacctcctcctgatattaagttcttccattcaatcatgcagaacctttgcacagaaggaagggtaatagaagcacgggatgtccttggcttgatagcgcacataggtatgaggcctaatgtttgcacatttaatatactgatcggtggatattgcctagtcggcaagatggaggatgcctcaaaaatatttgatgatatgatgtcatatggcttagaaccttctaatattacgtatggtatacttattaatggctattgcaaaaacgaaaggattaacgatgggctgattctgttcaaagaaatgttgcgcaagggacttaaacctacaacttttaattacaacgtcatactagatggattatttttggctggacgaactgttgctgcaaaggaaaagtttgatgagatggttgaatttggagtaagtgtgtgcattgatacatattcgatagttcttggtggactttgtagaaataattgtagcggcgaagcaatcacgctattccagaaattaagcacaatcgatgtgaaattcaatattacaattgtcaatataatgattgatgccttctacagggttcagcgaaaccaagaagccaaggatttgtttgctgcagtatcagccaatggtttggtagctaatgtctttacctacaccataatgatgaaaaatcttataaaagaagggtcagtggaagaagctgacgatctctttttatcaatggagaagagcggctgtactgctgactcttatatgttaaatcttatcgtcagaatgttactgggaaaaggagagatagtcaaggctgggaattatatatctaaaattgatgcaaagagctactcacttgaagctaaaactgtttcgctgcttatctctctcttttcagggaaagggaaatatagagaacacataggattgctccctgcaaagtatcggtttcgtgaagaagcagccacagttgtg

SEQ ID NO: 1855 - DNA, 2319 bp, Triticum aestivum
atgtcaaacacccgtctgtcctccaccttcacctcctccttgaaggctccttcacgaaaaccacgagccccccgcctcgccgccttggctgccgccacggagcgcgtccgcgctggaacgctaactcggcaggacgcgcgccagctgttcgacgaattgctgagccaagccgcgacagtcccagtacgcaccctgaacaactttcttgccgcactctcccgtgctccaccctcagctgcctgcagcgatggcccgggccttgccattgccctcttcaaccacatgtcccaaggcgctggtgcacgggtggtgtcgcccacgctctgtacctattccatcctcatggactgctgctgtcgtgcacgccgcccggacttggtggtttccttctttggccgcctccttaggttggggctgcgcttgaatgtcatctccttcaacaatctcctcaaggggctctgccaggccaagcgtacaaatgaggcggtggacttgctgctccaccggacacctgaactggactgtgtgcctaatgtcttctcgtacagcatcgtaatcaacgggtgttttaaacaaggtgaagtagacaaagcgtgcaatctcttcaatcagatgccccaactgggagttcaacctgatgtggtgatctacaactcaattatcgacgcactaagcaaatccggagcaatggacaaggcagaagtggtccttcggcaaatggttgatcaaggcattggaccaaacgtcatgacatatactagcctgatccatggatattccgcttcgggtcagtggaaggcggcagttagagtattcaaggaaatggtaagtgttggtgttcaaccaaatgctgtcgctttgaactcatttatggattcactttgcaagcatagaaggacaaaggaagctagagatatttttgactccatggctgcaaagggccagaaacctgatattttctcctattctactatgcttaacgggtatgtgaaagaaggatgctttgatgatatgactggtctcttcaatttgatgctacagaatggtgttgtacgaaaccaccatattttcaacatactgatcaatgcatatgctaaacgtggactgatggatgaggctatgcacatgttcgaagtaatgaggcaacaaggagtaaacccagatgtatttagctatcaaattgtaatggattcactttgcaaaatgggtaggatggatgctgctctggacaaatttaatcagatggtcaatcaaggagtttcacctaacatagttgtttaccgatgcctggttctgggttcttgctctcatggtgattttgtgaaagccaaggaattgatttctgaagcagttaatagaggtttgtgttctaacagtgtgttcttctatcctgtaataaacaatctgagcaaagaaggaaaggtaaaggaggcacaggatatgtttgacttcattgtaggtattggtcagcggcctgatgttattatgtaccattcactgatggatggatattgccttgttggcaaggtggaggaagcactgagagtacttgatgctatgaagtttgctggcctccaacctactgctgttacatacgctatacttcttaatggctactgtaaaagtggaaggattgctgctgggttgagtcttttcatggaaatgtcactcagcggggttaagcccactactattatgtacaacattatacttgatgggctgtttcgctccgggagaacagtttctgcaaaggaaaaattccgtacgatgagcgaaagtggcataccagtgggcattgacacatacaacatagttcttagtggactttgtaaaaataattgcgctggtgaagcaatagagctgttcaagaaactacgtgcaatgaatgtgaagattgatgtcaaaacactcactatcatgatttctgcaatgtttaaaagtaggagaattgaagaagccaaggagttgtttgctactatatcagccatcgggttggtgccttctgttgtgacttacagtgtaatgatgacgaatttcataaaagaagggtcgctggcagaggctgatgatatgtttttagcaatggagaaggctagctgtgctcccaactccatcctgctaaatcaagtggtcagggcgttgctggaaaaaggtgtagttgtaaaggctgcaacttatctggctaaacttgatgcaaaacagctgtcacttgaagcttcaacggtttcgttaatactatctctcttctcaaggaaagggaaattaagggagcatgtaaaattgcttccggtgaagtaccagcctcctgagatgttggac

SEQ ID NO: 1856 - DNA, 2472 bp, Triticum aestivum
atgtcccgcctccgccactccacctccaccgcgccggtgccccacctccgcctcctccgctgccgctcctcctccatctccaccttgccgccgtcacgctcatcgtctccccatgcagcctttgccgcagccacagagcgcgtcagcgctgggacgctcagcccggaagacgcacaccgcctgttcgacgaattgctacggcaggccactccggtccccgcgcgctccctgaacggcttcctcacggccctctcccgtgcgccggacaccggcgcctgcagagacggccccgccctcgccctctccctcttcaaccgcacccgccgagaagcggccggctcccgggtggtgtcgtccacaatcttcacctacggcatcctcatgaactgctgctgccgcacgcgtcgtccggagcttgggcttgccttctttgggcgcgtcctcaggatgggcctgaagacaaacgtggtcgtcgccaccacggtcctccagtgcctctgcggcgccaaacggacagacgaggctgtggacatcctgctacatcggatgtccgagctcgggtgcgtgcctgacgacttctcatacaacattgttctgaagagcttatgcgatgatagcaggagccagcgggcactcgacctgctccggatgtgggagaatgaacgaggtgtctgctcccccaacgtatatacgtataacacggtcatccacggcttctttaaggaaggtgaagtaagcaaggcatgtaatctatttcatgaaatggcgcagaaaggggttccgcccaatgtggtgacatatagcttgactattgatgcgctgtgcaaggccagagctatggacaaagcacagttgttcctccggcagatgattcataaaggtgttcgaccgaacattgtgacatataatgtcatgatccatggatattccactcttggccagtggaaagaagcaggtaaaatgttcagagaaatgacaggacagggactcataccagatattgttacttggacctcgttcatggcctctctctgtaagcatggaagaaccaaagaagctgccgaattttttgattccatgactgccaagggccacaagcctgatttggtcatgtatcatgttctgctccatgggtatgcaaccgaaggatgctttgctgatatgattaatctctttaattcaatggcaaccaaaggtattgtacccgatcgtcaggttttcaatattttaattgatgcacatgctaaacatggaatgatggatgaagctatgcacatatttactggaatgcagggacaaggagtgtgtccagatgtatggacctattcaactctaatatctgcactttgcagaatgggtaggctggctgatgccatggataacttcagtcagatgattggtaagggagtacaaccgaacacagttgtttatcactccctaattcagggtttctctacacatggtgatttgaggaaagcaaatgagttggtttatgaaatgacgaacaaaggtattccttgtccaaacattgcattcttcagttctataatggacagtctatgcaaagaaggaagggttatggatgcacatgatatcttccacttggttacagacataggtctgaaacctaacatcattacgtttaatacgctgattgatggacattgcttagtcggtgagatggagaaagcatttggagtacttgattccatggtatcagctggcattgaggctgatgtttttacatataatacacttgcttatggctattgtagatgtggaaggattgatgatgggttgattctattcagagaaatgttgcaaaacaaacctaaacccacaacaatcacatataacatcatactggatgggttatttcgtgctgggagaacatttgctgcaaagaaaatgttcgttgagatgatcgaaacgggaataacagtgagcatttccacatacagtataatacttggaggactttgtaggaataattgctctgacgaagcgatcaccctatttcagaaattaggagcaatgaatgtgaagtttgatattaaaatactcaataccatgatcaatgccatgttcaaggttcggagaagagaagaagctaacggtttgtttgctgcaatatcagccagtgggatggtacctaatacttctacctacagcgtaatgataggaaatcttctaaaagaaggatcagtggaagaagctgaaaatatgttctcattaatggagaagagtggttgtgctccagactctcgtcttataaataatatcatcagaatattgttggaaaacggtgacatcgtcaaggctggaaattatatgtctaaagttgatggcaagagcatctcacttgaagcttcaactacttcgttgttgatgtgtctcttttcaagtaaagggaaatatcgggaacaaatcagtttgctccctgtaaattaccaatttttcaatggagtcggt

SEQ ID NO: 1857 - DNA, 663 bp, Triticum aestivum
atgcctcgcttctcctccaccacgccgctgtcgccactccgccgccgcctccaccactcctcctccacctcccattcctcacgcagctgggagccccacgccgccttcgccgccgccacggagcgtgcgcgctctggcaacctcaccctggaggacgcacaccacctgttcgacgaattgctccggcagggcaatcctgtccaggaccgccccttgaacaaacttctctccgccctcgcccgtgctccggcgtccgcggcctgcagaaatggccctgcactcgcggtcgccctcttcagccgcatatcccaaggtgcccgccgacgagtggcggagccaacggtctgcacctacggcatcctcatggactgctgctgccgcgcacaccgcctggatctggcgctcgccttcttcggccatctcctcaagacgggcctggaggtagaccaagtcgtcttcaacaccctcctcaaaggcctttgccacgcaaagcgggcggatgaggctctggacgtgctgcttcacaggatgactgagctgggctgcacccccaacgtggtggcgtacaacaccataatccatggcttctttaaggaaggtcaagtaagcaaggcctgcaatctgttccatgaaatggcgcagcaggcgttccgcctaatgtgg

SEQ ID NO: 1858 - DNA, 1644 bp, Triticum aestivum
atggacaaggcagaggtggtccttcgtcaaatgattgatcgtagtgttggacctaatagcgtgacgtatagtagcctcatccatggatattcctcttcaggccactggaaggaggcagttagggtattcaaagagatgacaagtcggagggttacaccaaatgtgcatacttacaacatgtttataacctttctttgcaaacatggaagaagcaaagaagctgcaggaatttttgattccatggctatgaagggcctgaaacctgacgacgtttcatatgctattctccttcatgggtatgccaccgaaggatccttagttgatatgattaatctcttcaattcaatggaaagagactgtatcctaccagactgtcgtatcttcagcatactgattaatgcatatgctaaatctgggaaggttgataaggttatgcttatcttcaaaaaaatgcagaaacaaggagtgagtccagatgcagtcacatattcaaccctaatagatgcattttgtaaaaagggtcggttggacgatgctatgataaagtttaatcagatggttgatacaggagtacgacagggcacagctgtttatggttctctaatccagggtttttgtacacacggtgatttggtgaaaggaaaggaattggttactgaaatgatgaacaaaggtatacctcctcctgatattaagttcttccattcaatcatgcagaacctatgcacagaaggaagggtaatagaagcacgggatatccttggcttgatagcacacataggtatgaggcctaatgtttgcacatttaatatactgatcggtggatactgcctagtccgcaagatggagggtgcctcaaaaatatttcatgatatgatgtcatatggtttagaaccttctaatattacgtatggtatacttattaatggctattgcaaaaacttaaggattgacgatgggctgattctgttcaaagaaatgttgcgcaagggacttaaacctacaactttaaattataacattatactggatggcttatttctggctggacgaactgctgctgcaaaggaaaggttccatgagatggttgaatctggagcacatgtgtgcattgatacatactgtatagttcttggtggactttgtagaaataactgcagtagcgaagcaatcaccctattcgggaaattaagtgcaatgaatgtgagatttgatattacaattgtcaatatcattattggtgcattctacagggtcgagagaaaccaagaggctaaggatttgtttgctgctatgccagccaattgcttggttcctaatgctgttacctacaccataatgatgacaaatcttataaaagaaggttcagtggaagaagctgacaatctttttttatcgatggagaagagcggctgtactgccaactcttgcctgttaaatcatgtcatcaggaggttactggaaaaaggagagatagtcaaggctggaaattatatgtataaagttgatgcaaagaactactcacttgaagctaaaactgtttcactgctgatgtctctgtttacaaggaaagggaaatatagagaacacatcaaattgctccctgcaaagtatcagtttctggaagaagcagccacagttgaa

SEQ ID NO: 1859 - DNA, 2352 bp, Triticum aestivum
atgcctcgcttctcctccaccacgccgctgtcgccactccgccgccgcctccgccactcctcctccacctcccattcctcacgcagctgggagccccacgccgccttcgccgccgccacggagcgtgcgcgctctggcaacctcaccctggaggacgcacaccacctgttcgacgaattgctccggcagggcaatcctgtccaggaccgccccttgaacaaacttctctccgccctcgcccgtgctccggcgtccgcggcctgcagaaatggccctgcactcgcggtcgccctcttcagccgcatatcccaaggtgcccgccgacgagtggcggagccaacggtctgcacctacggcatcctcatggactgctgctgccgcgcacaccgcctggatctggcgctcgccttcttcggccatctcctcaagacgggcctggaggtagaccaagtcgtcttcaacaccctcctcaaaggcctttgccacgcaaagcgggcggatgaggctctggacgtgctgcttcacaggatgactgagctgggctgcacccccaacgtggtggcgtacaacaccataatccatggcttctttaaggaaggtcaagtaagcaaggcctgcaatctgttccatgaaatggcgcagcagggcgttccgcctaatgtggtgacatataattcagttatcgatgcgctgtgcaaggccagagccatggacaaggcagaggtggtccttcgtcaaatgattgatcgtagtgttggacctaatagcgtgacgtatagtagcctcatccatggatattcctcttcaggccactggaaggaggcagttagggtattcaaagagatgacaagtcggagggttacaccaaatgtgcatacttacaacatgtttataacctttctttgcaaacatggaagaagcaaagaagctgcaggaatttttgattccatggctatgaagggcctgaaacctgacgacgtttcatatgctattctccttcatgggtatgccaccgaaggatccttagttgatatgattaatctcttcaattcaatggaaagagactgtatcctaccagactgtcgtatcttcagcatactgattaatgcatatgctaaatctgggaaggttgataaggttatgcttatcttcaaaaaaatgcagaaacaaggagtgagtccagatgcagtcacatattcaaccctaatagatgcattttgtaaaaagggtcggttggacgatgctatgataaagtttaatcagatggttgatacaggagtacgacagggcacagctgtttatggttctctaatccagggtttttgtacacacggtgatttggtgaaaggaaaggaattggttactgaaatgatgaacaaaggtatacctcctcctgatattaagttcttccattcaatcatgcagaacctatgcacagaaggaagggtaatagaagcacgggatatccttggcttgatagcacacataggtatgaggcctaatgtttgcacatttaatatactgatcggtggatactgcctagtccgcaagatggagggtgcctcaaaaatatttcatgatatgatgtcatatggtttagaaccttctaatattacgtatggtatacttattaatggctattgcaaaaacttaaggattgacgatgggctgattctgttcaaagaaatgttgcgcaagggacttaaacctacaactttaaattataacattatactggatggcttatttctggctggacgaactgctgctgcaaaggaaaggttccatgagatggttgaatctggagcacatgtgtgcattgatacatactgtatagttcttggtggactttgtagaaataactgcagtagcgaagcaatcaccctattcgggaaattaagtgcaatgaatgtgagatttgatattacaattgtcaatatcattattggtgcattctacagggtcgagagaaaccaagaggctaaggatttgtttgctgctatgccagccaattgcttggttcctaatgctgttacctacaccataatgatgacaaatcttataaaagaaggttcagtggaagaagctgacaatctttttttatcgatggagaagagcggctgtactgccaactcttgcctgttaaatcatgtcatcaggaggttactggaaaaaggagagatagtcaaggctggaaattatatgtataaagttgatgcaaagaactactcacttgaagctaaaactgtttcactgctgatgtctctgtttacaaggaaagggaaatatagagaacacatcaaattgctccctgcaaagtatcagtttctggaagaagcagccacagttgaa

SEQ ID NO: 1860 - DNA, 2334 bp, Triticum aestivum
atgccgaccggccggctgtcctccatcttcaccagcaatgcaacctcctccttcagggctccttcgccacagccacgagcccctctcgccgccttggctgccgccacagagcgcgtgtgtgacggaacgctaagaccggaggaggcgcaccacctgttcgacgaattgctgagccaagccgccgccgtcccggaacgcgggctgaacaactttcttgccgcactagcccatgctccaccctcatctacctgcagcgatggcccgggccttgccatcgccctcttcaaccgcatgtcccgaggcgctggtgcacgggtggtgtcgcccacgctctgtacctattccattctcatggactgctgctgccgtgcaggccgcccggacttggtggttgccttctttggccgcctcctcagattggggctgtgcttgaatgtcatctccttcaacaacctcctcaaggggctctgccaggtcaagcgtacaaatgaggctgtggacttgctgctccaccggacacctgaactggactgtgtgcctaatgtcttctcgtacagcatcgtaatcaacggctgttttaaacaaggcgaagtagacaaagcgtgcaatctcttccatcagatgatccaactgggagttcaacctaatttggtgatctacaactcaattatcgacgcactaagcaaatccggagcaatggacaaggcagaagtggtccttcggcaaatggttgatcaaggaattgaacccaacatcaggacatatactagcctgatacatggatattccgcttcgggtcagtggaaggcggcagctagagtattcaaggaaatggtaagtgttggtgttctaccagatgctgtcgcgtggaactcatttatggattcactttgcaagcatagaaggacaaaggatgctagagttatttttgactccatggctgcaaagggccaaaaacctaatattgtctcctactctattatgctaaatgggtatgctaaagaaggatacttcgatgatatgactggtctcttcaatttgatgctacagaatggtattgtacctaaccaccatgttttcaacatactgatcaatgcatattctaaacgtgggctgatggatgaggctatgcacatgtttgaagtaatgaggcaacaaggagtaaacccagatgtatttggctatcaaattgtaatggattcactttgcaaaatgggtagggtggatgctgctctggacaaatttaatcagatggtcaatcaaggagtttcacccaacaaagctgtttaccaatgcctggttctgggttcttgctctaatggtgattttgtgaaagccaaggaattgatttctgaagcagttaatagaggtctgtgttctaacagtgtattcttctatcctgtaataaacaacctgagcaaagaaggaaaggtgaaggatgcacaggatatgtttgacttcattgtgggtattggtcgtccgcctgatgttattatgtacaattcactgatggatggatattgccttgttggcaaggtggaggaagcactgagagtacttgatgctatgaagtctgctggcctccaacctgatgcttttacatatggtatacttcttaatggctactgtaaaattggcaggatcgccgatggattgagtcttttcagggaaatgtcactcagcggggttaagcccacagctattatgtacaacattatacttgatgggctgtttcgctccgggagagcagtttctgcaaaggaaaaattctgtacgatgagcgaaagtggcataccagtgggcattggcacatacaacatagttcttcatggactttgtagaaacaattgcactgatgaagcaatagagctgttcaacaaattacgtgctatgaaattgaagattaatgtcataacaatcaataccatgatttctgctatgtttaaaactaggagaattgaagaagccaaggatttgtttgctactatatcagccattgggttggtgccttctgttgtgacttacagtgtaatgatgacgaatttcataaaagaagggttgctggcagaggctgatgatatgtttttagcaatggagaaggctggctgtgctcctgactccagactgctaaatcacgtggtcagagtgttgctggagaatggtgcagttgtaaaggctgcaacttatctcgctaaacttgatgcaaaccatctgtcacttgaagtttcaacgatttcattaatagtatctctcttctcaggggaagggaaactaagggagcatgtagagttgcttccagtaaagtaccagcctcctgagagttcggctgacaat

SEQ ID NO: 1861 - DNA, 2334 bp, Triticum aestivum
atgccgaccggccggctgtcctccatcttcaccagcaatgcaacctcctccttcagggctccttcgccacagccacgagcccctctcgccgccttggctgccgccacagagcgcgtgtgtgacggaacgctaagaccggaggaggcgcaccacctgttcgacgaattgctgagccaagccgccgccgtcccggaacgcgggctgaacaactttcttgccgcactagcccatgctccaccctcatctacctgcagcgatggcccgggccttgccatcgccctcttcaaccgcatgtcccgaggcgctggtgcacgggtggtgtcgcccacgctctgtacctattccattctcatggactgctgctgccgtgcaggccgcccggacttggtggttgccttctttggccgcctcctcagattggggctgtgcttgaatgtcatctccttcaacaacctcctcaaggggctctgccaggtcaagcgtacaaatgaggctgtggacttgctgctccaccggacacctgaactggactgtgtgcctaatgtcttctcgtacagcatcgtaatcaacggctgttttaaacaaggcgaagtagacaaagcgtgcaatctcttccatcagatgatccaactgggagttcaacctaatttggtgatctacaactcaattatcgacgcactaagcaaatccggagcaatggacaaggcagaagtggtccttcggcaaatggttgatcaaggaattgaacccaacatcaggacatatactagcctgatacatggatattccgcttcgggtcagtggaaggcggcagctagagtattcaaggaaatggtaagtgttggtgttctaccagatgctgtcgcgtggaactcatttatggattcactttgcaagcatagaaggacaaaggatgctagagttatttttgactccatggctgcaaagggccaaaaacctaatattgtctcctactctattatgctaaatgggtatgctaaagaaggatacttcgatgatatgactggtctcttcaatttgatgctacagaatggtattgtacctaaccaccatgttttcaacatactgatcaatgcatattctaaacgtgggctgatggatgaggctatgcacatgtttgaagtaatgaggcaacaaggagtaaacccagatgtatttggctatcaaattgtaatggattcactttgcaaaatgggtagggtggatgctgctctggacaaatttaatcagatggtcaatcaaggagtttcacccaacaaagctgtttaccaatgcctggttctgggttcttgctctaatggtgattttgtgaaagccaaggaattgatttctgaagcagttaatagaggtctgtgttctaacagtgtattcttctatcctgtaataaacaacctgagcaaagaaggaaaggtgaaggatgcacaggatatgtttgacttcattgtgggtattggtcgtccgcctgatgttattatgtacaattcactgatggatggatattgccttgttggcaaggtggaggaagcactgagagtacttgatgctatgaagtctgctggcctccaacctgatgcttttacatatggtatacttcttaatggctactgtaaaattggcaggatcgccgatggattgagtcttttcagggaaatgtcactcagcggggttaagcccacagctattatgtacaacattatacttgatgggctgtttcgctccgggagagcagtttctgcaaaggaaaaattctgtacgatgagcgaaagtggcataccagtgggcattggcacatacaacatagttcttcatggactttgtagaaacaattgcactgatgaagcgatagagctgttcaacaaattacgtgctatgaaattgaagattaatgtcataacaatcaataccatgatttctgctatgtttaaaactaggagaattgaagaagccaaggatttgtttgctactatatcagccattgggttggtgccttctgttgtgacttacagtgtaatgatgacgaatttcataaaagaagggttgctggcagaggctgatgatatgtttttagcaatggagaaggctggctgtgctcctgactccagactgctaaatcacgtggtcagagtgttgctggagaatggtgcagttgtaaaggctgcaacttatctcgctaaacttgatgcaaaccatctgtcacttgaagtttcaacgatttcattaatagtatctctcttctcaggggaagggaaactaagggagcatgtagagttgcttccagtaaagtaccagcctcctgagagttcggctgacaat

SEQ ID NO: 1862 - DNA, 2334 bp, Triticum aestivum; identical to SEQ ID NO: 1860

SEQ ID NO: 1863 - DNA, 2334 bp, Triticum aestivum; identical to SEQ ID NO: 1860

SEQ ID NO: 1864 - DNA, 2334 bp, Triticum aestivum; identical to SEQ ID NO: 1860

SEQ ID NO: 1865 - DNA, 2334 bp, Triticum aestivum; identical to SEQ ID NO: 1860

SEQ ID NO: 1866 - DNA, 2310 bp, Triticum aestivum
atgccaaccgcccgcctgtcctccatctccacctcctccttcagggctccttcacgagcccccctcgccgccttggctgccgccacggaacgcgttcgcgctggaacgctaagccgggaggatgcacaccacctattcgacgaattgcaaggccaagccgccgccgtcccagtacgcacgctgaacaactttcttgccgcactagcccgtgctccgccctcatccgcctgcagcgatggccctggccttgccatcgccctcttcaaccgcatgtcccgaggcgctggtgcacgggtggtgtctcccacgctctgtacctattccatcctcatggactgctgctgccgtgcaggccgcccggacttggtggttgccttcttctgccgcctcctcaggttggggctgcgctttgaggaggtcatctccttcaacaacctcctcaaggggctttgccaggccaagcgctcaaatgaggctttagatctgctgctccaccggatgcccgaactggactgtgcgcctgatgtcttctcgttcaacatagtaatcaacggctgccttaaagaaggtgaagtagacaaagcatgcaatctcttccatgagatgccccaactgggagttcaacctgatgtggtgacctacaactcaattattgacgcactaagcaagtccggagcaatggacaaggcagaagtgctccttcggcaaatggttgatcaaggaattgaacccaatatcaggacatatagctgtctgatccatggatattctacttttggtcagtggaaggaggcacttagggtattcaaagaaatggcaagtcttggtgttgtaccagacgttgtcacgttaagctcattaatcgattccctttgcaagcacagaaggacaaagcaagctagagaaatttttgactccatggctgcaaagggcctgaaacctgatatcgtctcctactctactatgcttaacgggtatgtcaaagaaggatccttcgaggatatgactgatctcttcaattcgatggtacggaatggtattgtacctaaccaccatattttcaacatactgatcaatgcatatgctaaacgtggactgatggatgaggctatgcacatgttcgaagtaatgaggcaacaaggagtaaacccaaatgtaattgactatctagtaataatggattcactttgtaaaatgggtaggatggatgctgctctggaaaaatttaatcagatggtcaatcaaggagtttcacctaacaaagctgtttaccaatgcctggttctgggttcttgctctcatggtcattttgtgaaagccaaggaattgatctctgaagcaattaatagaggtctgttttctaacagtgtgttcttctatcctgtaataaacgacctgtgcaaagaaggaaaggtgaaggaggcacatgatatgtttgacttcattgtaggtattggtcagcggcctgatgtgattatgtacaattcactgatggatggatattgccttgttggcaaggtggaggaagcactgagactacttgatgctatgaagtctgctggcctccaacctactggtgttacgtatgctatacttcttaatggctactgtaaaattggaaggatcgccgatggattgagtcttttcagggaaatgtcactcagcggggttaagcccactactattatgtacaacattatacttgatgggctgttttgctctgggagaacagtttctgcaaaggaagaattcgatacgatgagcgaaagtggcataccagtgaacgttcgcacatacaacatagttcttagtggactttgtagaaacaattgcactggtgaagcaatagagctgttcaagaaattacgtgctatgaacgtgaagattaatgtcataacactcaataccatgatttctgctatgtttaaaactaggagaattgaagaagccaaggatttgtttgctactatatcagccatcggattggtgccttctgttgtgacttacagtgtaatgatgacgaatttcataaaagaagggctgctagcagaggctgatgatatgtttttagcaatggagaaggctggatgtgctcccaactccagtttgctaaatcaagtggtcagagtgttgctggaaaaaggtgcagctgtacaggctgcaacttatctagctaaacttgatgcaaaacagctgtcacttgaagcttcaacggtttcgttaatactatctctcttctcaaggaaagggaaattaagggagcatgtaaaattgcttccggtaaagtaccagcctcctgagatgttggac

SEQ ID NO: 1867 - DNA, 2043 bp, Triticum aestivum
atgtcccgaggcgctggtgcacgggtagtgtcgcccacgctctgtacctattccatcctcatggactgctgctgccgcgcaggccgcccggacttggtggttgccttcttcggccgcctcatcaggttggggctgcgcttggagatcatctccttcagcaatctcctcaaggggctctgccaggccaagcgttcaaatgaggctttggacatgctgctccaccggatgcccgaactggattgtgcgcctgatgtcttctcgttcaacatagtaatcaacggctgctttaaagaaggtgaagtagacaaagcgtgcaatctcttccatgagatgccccaactgggagttcaacctgatgtggtgacctacaactcaattattgacgcactaagcaagtccagagccatggacaaggcagaagtggtccttcggcaaatggttgatcaaggcattgaacccaacatcaggacatatactagcctgatccatggatattccacttcgggtcagtggaaagcagcagttaggatattcaaagaaatggcaagtgctggtgttcgaccaaattctgtcacgttgaactcatttattgattccctttgcaagcatagaaagacaaaggaagctagagatatttttgactccatggctgcaaagggccacaaacctgatattttctcctactctactatgcttaatgggtatgcgaaagaaggatgcttcgatgatatgactgatctcttcaattcgatggtacggaatggtatcgtacctgaccaccatgttttcaatatactgatcaatgcatatgctaaacgtggactgatggataaggctatgcacatgttcgaagtaatgaggcaacaaggagtaaacccaaatgtagttgactatctagtagtaatggattcactttgcaaaatgggtaagatggctgctgctatggatatatttaatcagatggtcaatcaaggagtttcacctaacatagttgtttaccgatgcatggttctgggttcttgctctcatggtgattttgtgaaagccaaggaattgatctctgaagcagttaataaaggtctgtgttctaacagtgtgttcttctatcctgtaataaacaacctgtgcaaagaaggaaaggtaatggaggcacaagatatgtttgactttgacttcattgtcggtattggtcagcggcctgatgttattatgtacacttcacttatggatggatattgccttgttggcaaggtggagaaagcactgagagtactcgatgctatgaaatctgctggcctccaacctactgctgttacgtatggtgcacttcttaatggctactgtaaaattggaaagatcgccgatggattgagtcttttcagggaaatgtcactcagcggggttaagcccactactattatgtacaacattatacttgatgggctgttttgctctgggagaccagtttctgcaaaggaagaatttgatacgatgattgaaagtggcataccagtgggcgttgacacatacaacattgttcttagtgggctttgtaaaaataattgcactgatgaagcaatggatctgttcaagaaactacgtgcaacgaacatgaagattgatgtcataacactcaatatcatgatttctgcaatgtttaaaactaggagaattgaagaagccaaggatttgtttgctactatatcagccatcgggctggtgccttgtgttgtgacatacaacttaatgatgacgaacttcataaaagaagggttgctgccagaggctgatgatatgtttttagcaatggagaaggctaactgtgctcccaactccaggctgctaaatcatgtggtcaggttgttgctggaaaaaggtgcagttgtaaaggctgcaacttatctggctaaacttgatgcaaaccatctgtcacttgaagtttcaacgatttcgttaatagtatctctcttctcaggggaagggaaactaagggagcatgtagagttgcttccagtaaagtaccagcctccggagatgtccatc

SEQ ID NO: 1868 - DNA, 2334 bp, Triticum aestivum
atgccaaccggccgcctgtcctccatcttcaccagcaacgcaacctcctccttcagggctccttcgccacaaccacgaccccccctcgccgccttggctgccgccacggaacgcgttcgcgccggaacgctaagccgggaggaggcgcaccacctgttcgacgaattgcaaggccaagccgccgccgtcccggaacgcgggctgaacaactttcttgccgcactagcccgtgctccgccctcatctgcctgcggggatggccctgcccttgccgtcgccctcttcaaccgcatgtcccgaggcgctggtgcacgggtagtgtcgcccacgctctgtacctattccatcctcatggactgctgctgccgcgcaggccgcccggacttggtggttgccttcttcggccgcctcatcaggttggggctgcgcttggagatcatctccttcagcaatctcctcaaggggctctgccaggccaagcgttcaaatgaggctttggacatgctactccaccggatgcccgaactggattgtgcgcctgatgtcttctcgttcaacatagtaatcaacggctgctttaaagaaggtgaagtagacaaagcgtgcaatctcttccatgagatgccccaactgggagttcaacctgatgtggtgacctacaactcaattattgacgcactaagcaagtccagagccatggacaaggcagaagtggtccttcggcaaatggttgatcaaggcattgaacccaacatcaggacatatactagcctgatccatggatattccacttcgggtcagtggaaagcagcagttaggatattcaaagaaatggcaagtgctggtgttcgaccaaattctgtcacgttgaactcatttattgattccctttgcaagcatagaaagacaaaggaagctagagatatttttgactccatggctgcaaagggccacaaacctgatattttctcctactctactatgcttaatgggtatgcgaaagaaggatgcttcgatgatatgactgatctcttcaattcgatggtacggaatggtatcgtacctgaccaccatgttttcaatatactgatcaatgcatatgctaaacgtggactgatggataaggctatgcacatgttcgaagtaatgaggcaacaaggagtaaacccaaatgtagttgactatctagtagtaatggattcactttgcaaaatgggtaagatggctgctgctatggatatatttaatcagatggtcaatcaaggagtttcacctaacatagttgtttaccgatgcmtggttctgggttcttgctctcatggtgattttgtgaaagccaaggaattgatctctgaagcagttaataaaggtctgtgttctaacagtgtgttcttctatcctgtaataaacaacctgtgcaaagaaggaaaggtaatggaggcacaagatatgtttgactttgacttcattgtcggtattggtcagcggcctgatgttattatgtacacttcacttatggatggatattgccttgttggcaaggtggagaaagcactgagagtactcgatgctatgaaatctgctggcctccaacctactgctgttacgtatggtgcacttcttaatggctactgtaaaattggaaagatcgccgatggattgagtcttttcagggaaatgtcactcagcggggttaagcccactactattatgtacaacattatacttgatgggctgttttgctctgggagaccagtttctgcaaaggaagaatttgatacgatgattgaaagtggcataccagtgggcgttgacacatacaacattgttcttagtgggctgtgtaaaaataattgcactgatgaagcaatggatctgttcaagaaactacgtgcaacgaacatgaagattgatgtcataacactcaatatcatgatttctgcaatgtttaaaactaggagaattgaagaagccaaggatttgtttgctactatatcagccatcgggctggtgccttgtgttgtgacatacaacttaatgatgacgaacttcataaaagaagggttgctgccagaggctgatgatatgtttttagcaatggagaaggctaactgtgctcccaactccaggctgctaaatcatgtggtcaggttgttgctggaaaaaggtgcagttgtaaaggctgcaacttatctggctaaacttgatgcaaaccatctgtcacttgaagtttcaacgatttcgttaatagtatctctcttctcaggggaagggaaactaagggagcatgtagagttgcttccagtaaagtaccagcctccggagatgtccatc

SEQ ID NO: 1869 - DNA, 666 bp, Triticum aestivum
atgctgcacaagggacttaaacctacaacttttaattataacgtcattctggatggattatttctggctagacaaactgttgcttcaaaggtgaagtttcatgagatggctgaatctggagtaagtgtgtgcattgatacatactctatagttcttggtggactttgtagaaataattgcatcggtgaagcaatcacgctatttcagaaattaagtacaatgaatgttaaattcaatattgcaattgtcaatatcatgattggtgcattcttcagggttcggcgaaaccaggaagctaaggatttgtttgctgcagtatcagccaatggtttggtagctaatgtctttacctacactgtaatgatgataaatcttatagaagaagggtcactggaagaagctgacactctctttttatcaatgaagaagagcggctgtactgccaactcttgtatgttaaatcatattatcagaaggttactggaaagaggagagatagtcaaggctggaaattatatgtcgaaagttgatgcaaagagctactcacttgaagctaaaactgttttgctgctgatctctctcttttcagggaatgggaaatatagagaacacataaaattgctccctatgaagtatcagtttctcgaagaagcagccacagttgaa

SEQ ID NO: 1870 - DNA, 984 bp, Triticum aestivum
atgatgaagaaaggtatgcttcctcctgatattatgttcttcagttcaatcatgcagaacctatgcacagaaggaagggtaatagaagcacgagatatccttgacttgatagtgtgcattggtatgaggcctgatgttttcatatttaatatactgatcggcggatactgcctagtccgcaagatggcagatgcatcaaaaatatttgatgatatggtgtcatatggtttagaaccttgtaatattacgtatggtatacttattaatggctattgcaaaaacggaaggattgatgacgggcttattctgttcaaggagatgctgcacaagggacttaaacctacaacttttaattataacgtcattctggatggattatttctggctagacaaactgttgcttcaaaggtgaagtttcatgagatggctgaatctggagtaagtgtgtgcattgatacatactctatagttcttggtggactttgtagaaataattgcatcggtgaagcaatcacgctatttcagaaattaagtacaatgaatgttaaattcaatattgcaattgtcaatatcatgattggtgcattcttcagggttcggcgaaaccaggaagctaaggatttgtttgctgcagtatcagccaatggtttggtagctaatgtctttacctacactgtaatgatgataaatcttatagaagaagggtcactggaagaagctgacactctctttttatcaatgaagaagagcggctgtactgccaactcttgtatgttaaatcatattatcagaaggttactggaaagaggagagatagtcaaggctggaaattatatgtcgaaagttgatgcaaagagctactcacttgaagctaaaactgttttgctgctgatctctctcttttcagggaatgggaaatatagagaacacataaaattgctccctatgaagtatcagtttctcgaagaagcagccacagttgaa

SEQ ID NO: 1871 - DNA, 1461 bp, Triticum aestivum
atgaggattgtcctcaaaagtgccgagaaggactttgtcctatccwcyctcgycmccmtcsymytscwcwsskyttgckmastacacacaaaggccatgcctcgcttctcctccagcacgccaatgtcgccaccacgcctccgcctcctcctcctcctccgacttggcgcccgccactcctcctccacctctcatccctcacgcatctgggatccccacgccgccttcgccgccgcgacgcagcgggctcgctctggcacgctcaccacggaggacgcacaccacctgttcgaagaattgctgcggcagggcaatcctgtccaggagcgtcccttgactaactttctggctgcccttgcccgcgcgcccgcgtccccattctgcagcgatggccccgccctggccgtcgccctcttcagccgtttgtcccgaggcgccggacgacgggtggcacagccaaatgtcttcacctatggagtcctaatggactgctgctgccgtgcgcgccgcttggatgtagcgatcgccttcttcgcccatctcctcaagacgggactggaggcaggccaagtcgttttcggcaccctcctcaagggactgtgccacgcaaagcactcagatgaggctttggacgtggtgcttcacaggatgcctgagctaggctgcacccccgacgtggtggcctataccacggtcatccacggcttcttgaaggaaggccaagtaggcaaggcatgcaatctattccatggaatggcgcagcagggcgttgcgcctgatgtggtgacatatagctcagttattgatgcgctgtgcaaggccagagcaatggacaaggcagagtatttccttcgtgaaatggttgataatggtgtcgtacctaataatgtgacatataatagcctcatccatggatattcctctttgggccatcagaaggaggctgttagggtgctgaaagaaatgacaagacagggtatcatacctgatgtttttacttgcaactcggtcatggcctccctttgcaagaacggaaaaagcaaagaagctgcaaaaatgtttgattcaatgtccatgaagggcctgaaacctaacaccgtttcatatgttattctccttcatgggtatgccactgaaggatgcctagttgacatgatcaatctcttcaattccatggcaacagactgtattctacctaactgtcatatattcaacatactgatttatgcatatgctaaatctgggaagctcgacaaggctatgcttatatttaaagaaatgcagaaacaaggagtgagtccagatgcagtcacatattcaaccgtaatacatgcattttgcaaaaagggtaggttggatgatgctgtgataaagtttaatcagatgattgatacaggagtacgaccggacgcatctgtttatcgttccctaatccagggtgaaagcaaaggaatatgttac

SEQ ID NO: 1872 - DNA, 984 bp, Triticum aestivum; identical to SEQ ID NO: 1870

SEQ ID NO: 1873 - DNA, 2376 bp, Triticum aestivum
atgcctcgcttctcctccagcacgccaatgtcgccaccacgcctccgcctcctcctcctcctccgacttggcgcccgccactcctcctccacctctcatccctcacgcatctgggatccccacgccgccttcgccgccgcgacgcagcgggctcgctctggcacgctcaccacggaggacgcacaccacctgttcgaagaattgctgcggcagggcaatcctgtccaggagcgtcccttgactaactttctggctgcccttgcccgcgcgcccgcgtccccattctgcagcgatggccccgccctggccgtcgccctcttcagccgtttgtcccgaggcgccggacgacgggtggcacagccaaatgttttcacctatggagtcctaatggactgctgctgccgtgcgcgccgcttggatctagcgatcgccttcttcgcccatctcctcaagacgggactggaggcaggccaagtcgttttcggcaccctcctcaagggactctgccacgcaaagcactcagatgaggctttggacgtggtgcttcacaggatgcctgagctaggctgcacccccgacgtggtggcctataccacggtcatccacggcttcttgaaggaaggccaagtaggcaaggcatgcaatctattccatggaatggcgcagcagggcgttgcgcctgatgtggtgacatatagctcagttattgatgcgctgtgcaaggccagagcaattgacaaggcagagtatttccttcgtgaaatggttgataatggtgtcgtacctaataatgtgacatataatagcctcatccatggatattcctctttgggccatcagaaggaggctgttagggtgctgaaagaaatgacaagacagggtatcatacctgatgtttttacttgcaactcggtcatggcctccctttgcaagaacggaaaaagcaaagaagctgcaaaaatgtttgattcaatgtccatgaagggcctgaaacctaacaccgtttcatatgttattctccttcatgggtatgccactgaaggatgcctagttgacatgatcaatctcttcaattccatggcaacagactgtattctacctaactgtcatatattcaacatactgatttatgcatatgctaaatctgggaagctcgacaaggctatgcttatatttaaagaaatgcagaaacaaggagtgagtccagatgcagtcacatattcaaccgtaatacatgcattttgcaaaaagggtaggttggatgatgctgtgataaagtttaatcagatgattgatacaggagtacgaccggacgcatctgtttatcgttccctaatccagggtttttgtacacatggcgatttggtgaaagcaaaggaatatgttactgaaatgatgaagaaaggtatgcttcctcctgatattatgttcttcagttcaatcatgcagaacctatgcacagaaggaagggtaatagaagcacgagatatccttgacttgatagtgtgcattggtatgaggcctgatgttttcatatttaatatactgatcggcggatactgcctagtccgcaagatggcagatgcatcaaaaatatttgatgatatggtgtcatatggtttagaaccttgtaatattacgtatggtatacttattaatggctattgcaaaaacggaaggattgatgacgggcttattctgttcaaggagatgctgcacaagggacttaaacctacaacttttaattataacgtcatactggatggattatttctggctagacaaactgttgctgcaaaggtgaagtttcatgagatggctgaatctggagtaagtgtgtgcattgatacatactctatagttcttggtggactttgtagaaataattgcatcggtgaagcaatcacgctatttcagaaattaagtacaatgaatgttaaattcaatattgcaattgtcaatatcatgattggtgcattcttcagggttcggcgaaaccaggaagctaaggatttgtttgctgcagtatcagccaatggtttggtagctaatgtctttacctacactgtaatgatgataaatcttatagaagaagggtcactggaagaagctgacactctctttttatcaatgaagaagagcggctgtactgccaactcttgtatgttaaatcatattatcagaaggttactggaaagaggagagatagtcaaggctggaaattatatgtcgaaagttgatgcaaagagctactcacttgaagctaaaactgttttgctgctgatctctctcttttcagggaatgggaaatatagagaacacataaaattgctccctatgaagtatcagtttctcgaagaagcagccacagttgaa

SEQ ID NO: 1874 - DNA, 1365 bp, Triticum aestivum
atgcctcgcttctcctccagcacgccaatgtygccaccacgcctccgcctcctcctcctcctccgacttggcgcccgccactcctcctccacctctcatccctcacgcatctgggatccccacgccgccttcgccgccgcgacgcagcgggctcgctctggcacgctcaccacggaggacgcacaccacctgttcgaagaattgctgcggcagggcaatcctgtccaggagcgtcccttgactaactttctggctgcccttgcccgcgcgcccgcgtccccattctgcagcgatggccccgccctggccgtcgccctcttcagccgtttgtcccgaggcgccggacgacgggtggcacagccaaatgttttcacctatggagtcctaatggactgctgctgccgtgcgcgccgcttggatctagcgatcgccttcttcgcccatctcctcaagacgggactggaggcaggccaagtcgttttcggcaccctcctcaagggactctgccacgcaaagcactcagatgaggctttggacgtggtgcttcacaggatgcctgagctaggctgcacccccgacgtggtggcctataccacggtcatccacggcttcttgaaggaaggccaagtaggcaaggcatgcaatctattccatggaatggcgcagcagggcgttgcgcctgatgtggtgacatatagctcagttattgatgcgctgtgcaaggccagagcaattgacaaggcagagtatttccttcgtgaaatggttgataatggtgtcgtacctaataatgtgacatataatagcctcatccatggatattcctctttgggccatcagaaggaggctgttagggtgctgaaagaaatgacaagacagggtatcatacctgatgtttttacttgcaactcggtcatggcctccctttgcaagaacggaaaaagcaaagaagctgcaaaaatgtttgattcaatgtccatgaagggcctgaaacctaacaccgtttcatatgttattctccttcatgggtatgccactgaaggatgcctagttgacatgatcaatctcttcaattccatggcaacagactgtattctacctaactgtcatatattcaacatactgatttatgcatatgctaaatctgggaagctcgacaaggctatgcttatatttaaagaaatgcagaaacaaggagtgagtccagatgcagtcacatattcaaccgtaatacatgcattttgcaaaaagggtaggttggatgatgctgtgataaagtttaatcagatgattgatacaggagtacgaccggacgcatctgtttatcgttccctaatccagggtgaaagcaaaggaatatgttac

SEQ ID NO: 1875 - DNA, 2376 bp, Triticum aestivum
atgcctcgcttctcctccagcacgccaatgtcgccaccacgcctccgcctcctcctcctcctccgacttggcgcccgccactcctcctccacctctcatccctcacgcatctgggatccccacgccgccttcgccgccgcgacgcagcgggctcgctctggcacgctcaccacggaggacgcacaccacctgttcgaagaattgctgcggcagggcaatcctgtccaggagcgtcccttgactaactttctggctgcccttgcccgcgcgcccgcgtccccattctgcagcgatggccccgccctggccgtcgccctcttcagccgtttgtcccgaggcgccggacgacgggtggcacagccaaatgtcttcacctatggagtcctaatggactgctgctgccgtgcgcgccgcttggatgtagcgatcgccttcttcgcccatctcctcaagacgggactggaggcaggccaagtcgttttcggcaccctcctcaagggactgtgccacgcaaagcactcagatgaggctttggacgtggtgcttcacaggatgcctgagctaggctgcacccccgacgtggtggcctataccacggtcatccacggcttcttgaaggaaggccaagtaggcaaggcatgcaatctattccatggaatggcgcagcagggcgttgcgcctgatgtggtgacatatagctcagttattgatgcgctgtgcaaggccagagcaatggacaaggcagagtatttccttcgtgaaatggttgataatggtgtcgtacctaataatgtgacatataatagcctcatccatggatattcctctttgggccatcagaaggaggctgttagggtgctgaaagaaatgacaagacagggtatcatacctgatgtttttacttgcaactcggtcatggcctccctttgcaagaacggaaaaagcaaagaagctgcaaaaatgtttgattcaatgtccatgaagggcctgaaacctaacaccgtttcatatgttattctccttcatgggtatgccactgaaggatgcctagttgacatgatcaatctcttcaattccatggcaacagactgtattctacctaactgtcatatattcaacatactgatttatgcatatgctaaatctgggaagctcgacaaggctatgcttatatttaaagaaatgcagaaacaaggagtgagtccagatgcagtcacatattcaaccgtaatacatgcattttgcaaaaagggtaggttggatgatgctgtgataaagtttaatcagatgattgatacaggagtacgaccggacgcatctgtttatcgttccctaatccagggtttttgtacacatggcgatttggtgaaagcaaaggaatatgttactgaaatgatgaagaaaggtatgcttcctcctgatattatgttcttcagttcaatcatgcagaacctatgcacagaaggaagggtaatagaagcacgagatatccttgacttgatagtgtgcattggtatgaggcctgatgttttcatatttaatatactgatcggcggatactgcctagtccgcaagatggcagatgcatcaaaaatatttgatgatatggtgtcatatggtttagaaccttgtaatattacgtatggtatacttattaatggctattgcaaaaacggaaggattgatgacgggcttattctgttcaaggagatgctgcacaagggacttaaacctacaacttttaattataacgtcatactggatggattatttctggctagacaaactgttgctgcaaaggtgaagtttcatgagatggctgaatctggagtaagtgtgtgcattgatacatactctatagttcttggtggactttgtagaaataattgcatcggtgaagcaatcacgctatttcagaaattaagtacaatgaatgttaaattcaatattgcaattgtcaatatcatgattggtgcattcttcagggttcggcgaaaccaggaagctaaggatttgtttgctgcagtatcagccaatggtttggtagctaatgtctttacctacactgtaatgatgataaatcttatagaagaagggtcactggaagaagctgacactctctttttatcaatgaagaagagcggctgtactgccaactcttgtatgttaaatcatattatcagaaggttactggaaagaggagagatagtcaaggctggaaattatatgtcgaaagttgatgcaaagagctactcacttgaagctaaaactgttttgctgctgatctctctcttttcagggaatgggaaatatagagaacacataaaattgctccctatgaagtatcagtttctcgaagaagcagccacagttgaa

SEQ ID NO: 1876 - DNA, 543 bp, Triticum aestivum
atgccgaccggccggctgtcctccatcttcaccagcaatgcaacctcctccttcagggctccttcgccacagccacgagcccccctcgccgccttggctgccaccacagagcgcgtgtgtgccggaacgctaagaccggaggaggcgcaccacctgttcgacgaattgctgagccaagccgccgccgtcccggaacgcgggctgaacaactttcttgccgcactagcccgtgctccaccctcagctgcctgcagcgatggccccggccttgccatcaccctcttcaaccgcatgtcccgaggcgctggtgcacaggtggtgtcgcccacgctctgtacctattccattctcatggactgctgctgccgtgcaggccgcccggacttggtggttgccttctttggccgcctcctcagatcatctccttcaacaacctcctcaaggggctctgccaggtcaagcgtacaaatgaggctgtggacttgttgctccaccggacacctgaactggactgtgtgcctaatgtcttctcgtacagcatcg

SEQ ID NO: 1877 - DNA, 1095 bp, Triticum aestivum
atgccgaccggccggctgtcctccatcttcaccagcaatgcaacctcctccttcagggctccttcgccacagccacgagcccccctcgccgccttggctgccaccacagagcgcgtgtgtgccggaacgctaagaccggaggaggcgcaccacctgttcgacgaattgctgagccaagccgccgccgtcccggaacgggggctgaacaactttcttgccgcactagcccgtgctccaccctcagctgcctgcagcgatggccccggccttgccatcaccctcttcaaccgcatgtcccgaggcgctggtgcacaggtggtgtcgcccacgctctgtacctattccattctcatggactgctgctgccgtgcaggccgcccggacttggtggttgccttctttggccgcctcctcagattggggctgcacttgaatgtcatctccttcaacaacctcctcaaggggctctgccaggtcaagcgtacaaatgaggctgtggacttgttgctccaccggacacctgaactggactgtgtgcctaatgtcttctcgtacagcatcgtaatcaacggctgttttaaagaaggtgaagtagacaaagcgtgcaatctcttccatgagatgccccaactgggagttcaacctaatgtggtcatctacacctcaattatcgatgcactaagcaagtgcggagccatggacaaggcagaagtggtccttcagcaaatggttgatcaaggcattgaacccaacatcaggacatatactagcctgatacatggatattccgcttcgggtcagtggaaggcggcagctagagtattcaaggaaatggtaagtgctggtgttctaccaaatgctgtcactttgaactcatttatggattcactttgcaagcatagaaggacaaaggaaaagggcaacctggtgcatgtagctcccacttgcgcagggtccagggaagggtccgaccactttgggtctatagtacgcagcctttccctacatttctgtaagaggctgtttccaggacttgaacccatgacctcatggtcacaaggcagcagctttaccactgcgccaaggctcccctca

SEQ ID NO: 1878 - DNA, 816 bp, Triticum aestivum
atggatattgagcttgttggcaaggtggaggaagcactgagagtacttgatgctatgaagtctgctggcctccaacctactgctgttacgtatgctatacttcttaatggctactgtaaaattggcaggatcgccgatggattgagtcttttcagggaaatgtcactcagcggggttaaacccacgacttttatgtacaacattatacttgatgggctgtttcgctccgggagagcagtttctgcaaaggaaaaattccgtacgatgagcgaaagtggcataccagtgggcattgtcacatacaacatagttcttcatggattttgtagaaacaattgcactgatgaagcaatagagctgttcaagaaactacgtggaatgaatgtgaagattgatgtcataacactcactaccatgatttctgcaatgtttaaaactaggagaattgaagaagccaaggatttgtttgctactatatcagccattgggttggtgccttctgttgtgacttacagtgtaatgatgacgaatttcataaaagaagggttgctggcagaggctgatgatatgtttttagcaatggagaaggctggctgtgctcctgactcgagactgctaaatcacgtggtcagagtgttgctggagaatggtgcagttgtaaaggctgcaacttatctcgctaaacttgatgcaaaacagctgtcacttgaagcttcgacggtttcgttaatactatctctcttctcaaggaaagggaaattaagggagcatgtaaaattgcttccggtaaagtaccagcctcctgagatgttggac

SEQ ID NO: 1879 - DNA, 543 bp, Triticum aestivum; identical to SEQ ID NO: 1876

SEQ ID NO: 1880 - DNA, 1521 bp, Triticum aestivum
atgccgaccggccggctgtcctccatcttcaccagcaatgcaacctcctccttcagggctccttcgccacagccacgagcccccctcgccgccttggctgccaccacagagcgcgtgtgtgccggaacgctaagaccggaggaggcgcaccacctgttcgacgaattgctgagccaagccgccgccgtcccggaacgcgggctgaacaactttcttgccgcactagcccgtgctccaccctcagctgcctgcagcgatggccccggccttgccatcaccctcttcaaccgcatgtcccgaggcgctggtgcacaggtggtgtcgcccacgctctgtacctattccattctcatggactgctgctgccgtgcaggccgcccggacttggtggttgccttctttggccgcctcctcagattggggctgcgcttgaatgtcatctccttcaataacctcctcaaggggctctgccaggtcaagcgtacaaatgaggctgtggacttgttgctccaccggacacctgaactggactgtgtgcctaatgtcttctcgtacagcatcgtaatcaacggctgttttaaagaaggtgaagtagacaaagcgtgcaatctcttccatgagatgccccaactgggagttcaacctaatgtggtcatctacacctcaattatcgatgcactaagcaagtgcggagccatggacaaggcagaagtggtccttcagcaaatggttgatcaaggcattgaacccaacatcaggacatatactagcctgatacatggatattccgcttcgggtcagtggaaggcggcagctagagtattcaaggaaatggtaagtgttggtgttctaccaaatgctgtcactttgaactcatttatggattcactttgcaagcatagaaggacaaaggatgctagagatatttttgactccatggctgcaaagggccaaaaacctgacattttctcctactctattatgctaaatgggtatgctaaagaaggatacttcgaggatatgactgatctcttcaatttgatggtactgaatggtattgtacctaaccaccatattttcaacatactgatcaatgcatatgctaaacgtggactgatggatgaggctatgcacatgttcgaagtaatgaggcaacaaggagtaaacccaaatgtagttgactatgtagtagtaatggattcactttgcaaaatgggtaggatggatgctgctctggacaaatttactcagctggtcaatcaaggagtttcacctaacaaagctgtttaccaatgcctggttctgggttcttgctctcatggtcattttgtgaaagccaaggaattgatctctgaagcaattaatagaggtctgttttctaacagtgtgttcttctatcctgtaataaacgacctatgcaaagaaggaaaggtgaaggaggcacaggatatgtttgacttcattctaggtattggtcggcggcctgatgtgattatgtacaattcactgatggatggatat

SEQ ID NO: 1881 - DNA, 2328 bp, Triticum aestivum
atgccgaccggccggctgtcctccatcttcaccagcaatgcaacctcctccttcagggctccttcgccacagccacgagcccccctcgccgccttggctgccaccacagagcgcgtgtgtgccggaacgctaagaccggaggaggcgcaccacctgttcgacgaattgctgagccaagccgccgccgtcccggaacgcgggctgaacaactttcttgccgcactagcccgtgctccaccctcagctgcctgcagcgatggccccggccttgccatcaccctcttcaaccgcatgtcccgaggcgctggtgcacaggtggtgtcgcccacgctctgtacctattccattctcatggactgctgctgccgtgcaggccgcccggacttggtggttgccttctttggccgcctcctcagattggggctgcgcttgaatgtcatctccttcaacaacctcctcaaggggctctgccaggtcaagcgtacaaatgaggctgtggacttgttgctccaccggacacctgaactggactgtgtgcctaatgtcttctcgtacagcatcgtaatcaacggctgttttaaagaaggtgaagtagacaaagcgtgcaatctcttccatgagatgccccaactgggagttcaacctaatgtggtcatctacacctcaattatcgatgcactaagcaagtgcgtagccatggacaaggcagaagtggtccttcagcaaatggttgatcaaggcattgaacccaacatcaggacatatactagcctgatacatggatattccgcttcgggtcagtggaaggcggcagctagagtattcaaggaaatggtaagtgttggtgttctaccaaatgctgtcactttgaactcatttatggattcactttgcaagcatagaaggacaaaggatgctagagatatttttgactccatggctgcaaagggccaaaaacctgatattttctcctactctattatgctaaatgggtatgctaaagaaggatacttcgaggatatgactgatctcttcaatttgatggtactgaatggtattgtacctaaccaccatattttcaacatactgatcaatgcatatgctaaacgtggactgatggatgaggctatgcacatgttcgaagtaatgaggcaacaaggagtaaacccaaatgtagttgactatgtagtagtaatggattcactttgcaaaatgggtaggatggatgctgctctggacaaatttactcagatggtcaatcaaggagtttcacctaacaaagctgtctaccaatgcctggttctgggttcttgctctcatggtcattttgtgaaagccaaggaattgatctctgaagcaattaatagaggtctgttttctaacagtgtgttcttctatcctgtaataaacgacctatgcaaagaaggaaaggtgaaggaggcacaggatatgtttgacttcattctaggtattggtcggcggcctgatatgattatgtacaattcactgatggatggatattgccttgttggcaaggtggaggaagcactgagagtacttgatgctatgaagtctgctggcctccaacctactgctgttacgtatgctatacttcttaatggctactgtaaaattggcaggatcgccgatggattgagtcttttcagggaaatgtcactcagcggggttaaacccacgacttttatgtacaacattatacttgatgggctgtttcgctccgggagagcagtttctgcaaaggaaaaattccgtacgatgagcgaaagtggcataccagtgggcattgtcacatacaacatagttcttcatggattttgtagaaacaattgcactgatgaagcaatagagctgttcaagaaactacgtggaatgaatgtgaagattgatgtcataacactcactaccatgatttctgcaatgtttaaaactaggagaattgaagaagccaaggatttgtttgctactatatcagccattgggttggtgccttctgttgtgacttacagtgtaatgatgacgaatttcataaaagaagggttgctggcagaggctgatgatatgtttttagcaatggagaaggctggctgtgctcctgactcgagattgctaaatcatgtggtcagagtgttgctggagaatggtgcagttgtaaaggctgcaacttatctcgctaaacttgatgcaaaacagctgtcacttgaagcttcgacggtttcgttaatactatctctcttctcaaggaaagggaaattaagggagcatgtaaaattgcttccggtaaagtaccaacctcctgagatgttggac

SEQ ID NO: 1882 - DNA, 1521 bp, Triticum aestivum
atgccgaccggccggctgtcctccatcttcaccagcaatgcaacctcctccttcagggctccttcgccacagccacgagcccccctcgccgccttggctgccaccacagagcgcgtgtgtgccggaacgctaagaccggaggaggcgcaccacctgttcgacgaattgctgagccaagccgccgccgtcccggaacgcgggctgaacaactttcttgccgcactagcccgtgctccaccctcagctgcctgcagcgatggccccggccttgccatcaccctcttcaaccgcatgtcccgaggcgctggtgcacaggtggtgtcgcccacgctctgtacctattccattctcatggactgctgctgccgtgcaggccgcccggacttggtggttgccttctttggccgcctcctcagattggggctgcgcttgaatgtcatctccttcaacaacctcctcaaggggctctgccaggtcaagcgtacaaatgaggctgtggacttgttgctccaccggacacctgaactggactgtgtgcctaatgtcttctcgtacagcatcgtaatcaacggctgttttaaagaaggtgaagtagacaaagcgtgcaatctcttccatgagatgccccaactgggagttcaacctaatgtggtcatctacacctcaattatcgatgcactaagcaagtgcggagccatggacaaggcagaagtggtccttcagcaaatggttgatcaaggcattgaacccaacatcaggacatatactagcctgatacatggatattccgcttcgggtcagtggaaggcggcagctagagtattcaaggaaatggtaagtgttggtgttctaccaaatgctgtcactttgaactcatttatggattcactttgcaagcatagaaggacaaaggatgctagagatatttttgactccatggctgcaaagggccaaaaacctgacattttctcctactctattatgctaaatgggtatgctaaagaaggatacttcgaggatatgactgatctcttcaatttgatggtactgaatggtattgtacctaaccaccatattttcaacatactgatcaatgcatatgctaaacgtggactgatggatgaggctatgcacatgttcgaagtaatgaggcaacaaggagtaaacccaaatgtagttgactatgtagtagtaatggattcactttgcaaaatgggtaggatggatgctgctctggacaaatttactcagatggtcaatcaaggagtttcacctaacaaagctgtttaccaatgcctggttctgggttcttgctctcatggtcattttgtgaaagccaaggaattgatctctgaagcaattaatagaggtctgttttctaacagtgtgttcttctatcctgtaataaacgacctatgcaaagaaggaaaggtgaaggaggcacaggatatgtttgacttcattctaggtattggtcggcggcctgatgtgattatgtacaattcactgatggatggatat

SEQ ID NO: 1883 - DNA, 816 bp, Triticum aestivum
atggatattgagcttgttggcaaggtggaggaagcactgagagtacttgatgctatgaagtctgctggcctccaacctactgctgttacgtatgctatacttcttaatggctactgtaaaattggcaggatcgccgatggattgagtcttttcagggaaatgtcactcagcggggttaaacccacgacttttatgtacaacattatacttgatgggctgtttcgctccgggagagcagtttctgcaaaggaaaaattccgtacgatgagcgaaagtggcataccagtgggcattgtcacatacaacatagttcttcatggattttgtagaaacaattgcactgatgaagcaatagagctgttcaagaaactacgtggaatgaatgtgaagattgatgtcataacactcactaccatgatttctgcaatgtttaaaactaggagaattgaagaagccaaggatttgtttgctactatatcagccattgggttggtgccttctgttgtgacttacagtgtaatgatgacgaatttcataaaagaagggttgctggcagaggctgatgatatgtttttagcaatggagaaggctggctgtgctcctgactcgagactgctaaatcacgtggtcagagtgttgctggagaatggtgcagttgtaaaggctgcaacttatctcgctaaacttgatgcaaaacagctgtcacttgaagcttcgacggtttcgttaatactatctctcttctcaaggaaagggaaattaagggagcatgtaaaattgcttccggtaaagtaccagcctcctaagatgttggac

SEQ ID NO: 1884 - DNA, 1521 bp, Triticum aestivum; identical to SEQ ID NO: 1880

SEQ ID NO: 1885 - DNA, 816 bp, Triticum aestivum
atggatattgagcttgttggcaaggtggaggaagcactgagagtacttgatgctatgaagtctgctggcctccaacctactgctgttacgtatgctatacttcttaatggctactgtaaaattggcaggatcgccgatggattgagtcttttcagggaaatgtcactcagcggggttaaacccacgacttttatgtacaacattatacttgatgggctgtttcgctccgggagagcagtttctgcaaaggaaaaattccgtacgatgagcgaaagtggcataccagtgggcattgtcacatacaacatagttcttcatggattttgtagaaacaattgcactgatgaagcaatagagctgttcaagaaactacgtggaatgaatgtgaagattgatgtcataacactcactaccatgatttctgcaatgtttaaaactaggagaattgaagaagccaaggatttgtttgctactatatcagccattgggttgttgccttctgttgtgacttacagtgtaatgatgacgaatttcataaaagaagggttgctggcagaggctgatgatatgtttttagcaatggagaaggctggctgtgctcctgactcgagactgctaaatcacgtggtcagagtgttgctggagaatggtgcagttgtaaaggctgcaacttatctcgctaaacttgatgcaaaacagctgtcacttgaagcttcgacggtttcgttaatactatctctcttctcaaggaaagggaaattaagggagcatgtaaaattgcttccggtaaagtaccagcctcctgagatgttggac

SEQ ID NO: 1886 - DNA, 816 bp, Triticum aestivum; identical to SEQ ID NO: 1878

SEQ ID NO: 1887 - DNA, 2313 bp, Triticum aestivum
atgccagccgcccgcctgtcctccatctccacctcctccttcagggctccttcacgagcccccctggccgccttggctgccgccacggagcgtgtgcgcgcgggaacgctgagccaggaggacgcgcaccacctgttcgacgaattgcttggccaagctgccgccgtcccggaacgcgggctcaacaactttcttgccgcactcgctcgtgctccaccctcagctgcctgccgcgatggcccgggccttgccatcgccctcttcaaccacatgtcccgaggcgctggtgcacgggtggtgtcgcccacactatgtacctattccatcctcatggactgctgctgccgcgcaggccgcccggacttggtggttgccttcttcggtcgcctcattaggttggggctgcgcttggaggtcatctccttcagcaatctcctcaaggggctctgccaggccaagcgtacaaatgaggcggtggacttgctgctccaccggacacctgaactggactgtgtgcctaatgtcttctcgtacaacatcgtaatcagcagctgttttaaagaaggtgaagtagacaaagcgtgcaatctcttccatgagatgccccaactgggagttcaacctaatgtggtcatctacacctcaattatcgatgcactaagcaagtgcggagccatggacaaggcagaagtggtccttcagcaaatggttgatcaaggcattgaacccgacatcaggacatatactagcctgatacatggatattctgcttcgggtcagtggaaggcggcagttagagtattcaaggaaatggtaagtgttggtgttctaccaaatgctgtcactttgaactcatttatggattcactttgcaagcatagaaggacaaaggaagctagagaaatttttgactctatggctgcaaagggcctgaaacctaatatcgtctcctactctactatgcttaatgggtatgtcaaagaaggatccttcgaggatatgactgatctcttcaattcgatggtacggaatggtattgtacctaaccaccatattttcaacatactgatcaatgcatatgctaaacgtggactgatggatgaggctatgcacatgttcgaagtaatgaggcaacaaggagtaaacccggatgtatttgactatcaaatcataatggattcactttgcaaaatgggtaggatggatgctgctctggacaaatttaatcagatggtcaatcaaggagtttcacctaacaaagctgtttaccaatgcctggttctgggttcttgctctcatggtgattttgtgaaagccaaggaattgatttctgaagcagttaatagaggtctgtgttctaacagtgtgttcttctatcctgtaataaacgacctttgcaaagaaggaaaggtaaaggaggcccaggatatgtttgacttcatcctaggtattggtcagcggcctgatgtgattatgtacacttcactgatggatggatattgccttgttggcaaggtggagaaagcactgagtgtactcgatgctatgaaatctgctggcctccaacctgatgatgttgtatatgctacacttcttaacggttactgtaaaattggaaggattgccgatggattgagccttttcagggaaatgtcactcagcggggttaagcccacgactattatatacaacattatactggatgggctgttttgctctgggagaacaggttctgcaaaggaaaaattccatacgatgactgaaagtggcataccagtaggcgttgacacatacaacatagttcttagtggactttgtagaaacaattgcactgatgaagcaatagaactgttcaagaaactacgtgcaacgaacgtgaagattgatatcatgacactcaatatcatgatttctgcaatgtttaaaactaggagaattgaagaagccaaggatttgtttgctactatatcagccatcggattggtgccttctgttgtgacttacagtttaatgatgacgaatttcataaaagaagggttgttggcagatgctgatgatacctttttggtaatggagaaagctggctgtgctcccaactccagtctgctaaatcaggtggtcagggtgttgctggaaaaaggtgcatttgtaaaggctgcaacttatctcgctaaacttgatgctaaacagctgtcagttgaagcttcaacgatttcgttaatagtatctctcttctcaggggaagggaaaccaagggagcatgtagagttgcttccagtaaagtaccagcctcctcagagttcggctgacaat

SEQ ID NO: 1888 - DNA, 2313 bp, Triticum aestivum
atgccggccgcccgcctgtcctccatccccacctcctccttcagggcttcttcacgagcccccctcgccgccttggctgtcgccacggaacgcgttcgcgctggaacgctaagccgggaggacgcgcaccacctgttcgacgaattgcttggccaagccgccgctgtcccggaacgcgggctcaacaactttcttgccgcactcgcccgtgctccaccctcagctgcctgccgcgatggccccggccttgccatcgccctcttcaaccgcatgtcccgaggcactggtgcacgggtggtgtcgcccacgctctgtacctattccatcctcatggactgctgctgccgtgcaggccgcccggacttggtggttgccttcttcggccgcctcctcaggttggggctgcgcttggacgtcatctccttaagcaatctcctcaaggggctttgccaggctaagcgctcaaatgaggcattggatctgctgctccaccggatgcccgaactacactgtgcgcctggtgtcttctcgtacaacatagtaatcaacggctgcttgaaagaaggtgaagtagacaaagcgtgcaatctcttccatgagatgccccaactgggagttcaacctgatgtggtgacctacacctcaatcatggacgcactaagcaagtctggagcaatggacaaggcagaagtgctccttcggcaaatggttgatcaaggaattgaacccaatattaggacatatagctgtctgatccatggatattctacttttggtcagtggaaggaggcacttagggtattcaaagaaatggcaactcttggtgttgtaccagacgttgtcacgttgagctcattaatcgattccctttgcaagcacagaaggacaaaggaagctagagaaatttttgactctatggctgcaaagggcctgaaacctaatatcgtctcctactctactatgcttaatgggtatgtcaaagaaggatccttcgaggatatgactgatctcttcaattcaatggtacggaatggtattgtacctgaccaccatattttcaacatacagatcaatgcatatgctaaacgtggactgatggatgaggctatgcacatgttcgaagtaatgaggcaacaaggagtaaacccggatgtatttgactatcaaatcataatggattcactttgtaaaatgggtaggatggatgctgctctggacaaatttaatcagatggtcaatcaaggagtttcacctaacaaagctgtttaccaatgcctggttctgggttcttgctctcatggtgattttgtgaaagccaaggaattgatttctgaagcggttaatagaggtctgtgttctaacagtgtgttcttctatcctgtaataaacgacctttgcaaagaaggaaaggtaaaggaggcacaggatatgtttgacttcatcctaggtattggtcagcggcctgatgtgattatgtacacttcactgatggatggatattgccttgttggcaaggtggagaaagcactgagtgtactcgatgctatgaaatttgctggccttcaacctgatgatgttgtatatggtacacttcttaacagttactgtaaaattggaaggattgccgatggattgagccttttcagggaaatgtcactcagcggggttaagcccacgactattatatacaacattatactggatgggctgttttgctctgggagaacaggttctgcaaaggaaaaattccatacgatgactgaaagtggcataccagtaggcgttgacacatacaacatagttcttagtggactttgtagaaacaattgcactgatgaagcaatagaactgttcaagaaactacgtgcaacgaacgtgaagattgatgtcatgacactcaatatcatgatttctgcaatgtttaaaactaggagaattgaagaagccaaggatttgtttgctactatatcagccattggattggtgccttctgttgtgacttacagtttaatgatgacgaatttcataaaagaagggttgttggcagacgctgatgatacctttttggtaatggagaaagctggctgtgctcccaactccagtctgctaaatcaggtggtcagggtgttgctggaaaaaggtgcagttttaaaggctgcaacttatctcgctaaacttgatgctaaacagctgtcagttgaagtttcaacgatttcgttaatagtatctctcttctcaggggaagggaaactaagggagcatgtagagttgcttccagtaaagtaccagcctcctcagagttcggctgacaat

SEQ ID NO: 1889 - DNA, 2043 bp, Triticum aestivum
atgtcccgaggcgctggtgcacgggtggtgtcgcccacgctctgtacctattccatcctcatggactgctgctgccgtgcaggccgcccggacttggtgcttgccttcttcggccgcctcctcaggttggggctgcgcttggacgtcatctccttaagcaatctcctcaaggggctttgccaggctaagcgctcaaatgaggcattggatctgctgctccaccggatgcccgaactacactgtgcgcctgatgtcttctcgtacaacatagtaatcaacggctgcttgaaagaaggtgaagtagacaaagcgtgcaatctcttccatgagatgccccaactgggagttcaacctgatgtggtgacctacacctcaatcatggacgcactaagcaagtccggagcaatggacaaggcagaagtgctccttcggcaaatggttgatcaaggaattgaacccaatatcaggacatatagctgtctgatccatggatattctacttttggtcagtggaaggaggcacttagggtattcaaagaaatggcaagtcttggtgttgtaccagacgttgtcacgttgagctcattaatcgattccctttgcaggcacagaaggacaaagcaagctagagaaatttttgactctatggctgcaaagggcctgaaacctaatatcgtctcctactctactatgcttaaagggtatgtcaaagaaggatccttcgaggatatgactgatctcttcaattcgatggtacggaatggtattgtacctgaccaccatattttcaacatacagatcaatgcatatgctaaacgtggactgatggatgaggctatgcacatgttcgaagtaatgaggcaacaaggagtaaacccggatgtatttgactatcaaatcataatggattcactttgtaaaatgggtaggatggatgctgctctggacaaatttaatcagatggtcaatcaaggagtttcacctaacaaagctgtttaccaatgcctggttctgggttcttgctctcatggtgattttgtgaaagccaaggaattgatttctgaagcggttaatagaggtctgtgttctaacagtgtgttcttctatcctgtaataaacgacctttgcaaagaaggaaaggtaaaggaggcacaggatatgtttgacttcatcctaggtattggtcagcggcctgatgtgattatgtacacttcactgatggatggatattgccttgttggcaaggtggagaaagcactgagtgtactcgatgctatgaaatttgctggccttcaacctgatgatgttgtatatggtacacttcttaacggttactgtaaaattggaaggattgccgatggattgagccttttcagggaaatgtcactcagcggggttaagcccacgactattatatacaacattatactggatgggctgttttgctctgggagaacaggttctgcaaaggaaaaattccatacgatgactgaaagtggcataccagtaggcgttgacacatacaacatagttcttagtggactttgtagaaacaattgcactgatgaagcaatagaactgttcaagaaactatgtgcaacgaacgtgaagattgatgtcatgacactcaatatcatgatttctgcaatgtttaaaactaggagaattgaagaagccaaggatttgtttgctactatatcagccatcggattggtgccttctgttgtgacttacagtttaatgatgacgaatttcataaaagaagggttgttggcagacgctgatgatacctttttggtaatggagaaagctggctgtgctcccaactccagtctgctaaatcaggtggtcagggtgttgctggaaaaaggtgcagttttaaaggctgcaacttatctcgctaaacttgatgctaaacagctgtcagttgaagtttcaacgatttcgttaatagtatctctcttctcaggggaagggaaactaagggagcatgtagagttgcttccagtaaagtaccagcctcctcagagttcggctgacaat

SEQ ID NO: 1890 - DNA, 2043 bp, Triticum aestivum; identical to SEQ ID NO: 1889

SEQ ID NO: 1891 - DNA, 2313 bp, Triticum aestivum; identical to SEQ ID NO: 1888

SEQ ID NO: 1892 - DNA, 1557 bp, Triticum aestivum
  misc_feature (1048)..(1048): n is a, c, g, or t
  misc_feature (1549)..(1549): n is a, c, g, or t
atgccccaactgggagttcaacctgatgtggtgacctacacctcaatcatggacgcactaagcaagtccggagcaatggacaaggcagaagtgctccttcggcaaatggttgatcaaggaattgaacccaatatcaggacatatagctgtctgatccatggatattctacttttggtcagtggaaggaggcacttagggtattcaaagaaatggcaagtcttggtgttgtaccagacgttgtcacgttgagctcattaatcgattccctttgcaggcacagaaggacaaagcaagctagagaaatttttgactctatggctgcaaagggcctgaaacctaatatcgtctcctactctactatgcttaaagggtatgtcaaagaaggatccttcgaggatatgactgatctcttcaattcgatggtacggaatggtattgtacctgaccaccatattttcaacatacagatcaatgcatatgctaaacgtggactgatggatgaggctatgcacatgttcgaagtaatgaggcaacaaggagtaaacccagatgtatttggctatcaaatcataatggattcactttgtaaaatgggtaagatggatgctgctctggacaaatttaatcagatggtcaatcaaggagtttcacctaacaaagctgtttaccaatgcctggttctgggttcttgctctcatggtgattttgtgaaagccaaggaattgatttctgaagcggttaatagaggtatgtgttctaacagtgtgttcttctatcctgtaataaacgacctttgcaaagaaggaaaggtaaaggaggcacaggatatgtttgacttcatcctaggtattggtcagcggcctgatgtgattatgtacacttcactgatggatggatattgccttgttggcaaggtggagaaagcactgagtgtactcgatgctatgaaatttgctggccttcaacctgatgatgttgtatatggtacacttcttaacagttactgtaaaattggaaggattgccgatggattgagccttttcaggnaaatgtcactcagcggggttaagcccacgactattatatacaacattatactggatgggctgttttgctctgggagaacaggttctgcaaaggaaaaattccatacratgactgaaagtggcataccagtaggcgttgacacatacaacatagttcttagtggactttgtagaaacaattgcactgatgaagcaatagaactgttcaagaaactacgtgcaacgaacgtgaagattgatgtcatgacactcaatatcatgatttctgcaatgtttaaaactaggagaattgaagaagccaaggatttgtttgctactatatcagccatcggattggtgccttctgttgtgacttacagtttaatgatgacgaatttcataaaagaagggttgttggcagacgctgatgatacctttttggtaatggagaaagctggctgtgctcccaactccagtctgctaaatcargtggtcagggygttgctggaaaaaggtgcagttntaaatgaa

SEQ ID NO: 1893 - DNA, 2043 bp, Triticum aestivum; identical to SEQ ID NO: 1889

SEQ ID NO: 1894 - DNA, 2313 bp, Triticum aestivum
atgccggccgcccgcctgtcctccatccccacctcctccttcagggcttcttcacgagcccccctagccgccttggctgtcgccacggaacgcgttcgcgctggaacgctaagccgggaggacgcgcaccacctgttcgacgaattgcttggccaagccgccgctgtcccggaacgcgggctcaacaactttcttgccgcactcgcccgtgctccaccctcagctgcctgccgcgatggccccggccttgccatcgccctcttcaaccgcatgtcccgaggcactggtgcacgggtggtgtcgcccacgctctgtacctattccatcctcatggactgctgctgccgtgcaggccgcccggacttggtgcttgccttcttcggccgcctcctcaggttggggctgcgcttggacgtcatctccttaagcaatctcctcaaggggctttgccaggctaagcgctcaaatgaggcattggatctgctgctccaccggatgcccgaactacactgtgcgcctggtgtcttctcgtacaacatagtaatcaacggctgcttgaaagaaggtgaagtagacaaagcgtgcaatctcttccatgagatgccccaactgggagttcaacctgatgtggtgacctacacctcaatcatggacgcactaagcaagtccggagcaatggacaaggcagaagtgctccttcggcaaatggttgatcaaggaattgaacccaatatcaggacatatagctgtctgatccatggatattctacttttggtcagtggaaggaggcacttagggtattcaaagaaatggcaactcttggtgttgtaccagacgttgtcacattgagctcattaatcgattccctttgcaagcacagaaggacaaaggaagctagagaaatttttgactctatggctgcaaagggcctgaaacctaatatcgtctcctactctactatgcttaatgggtatgtcaaagaaggatccttcgaggatatgactgatctcttcaattcgatggtacggaatggtattgtacctgaccaccatattttcaacatacagatcaatgcatatgctaaacgtggactgatggatgaggctatgcacatgttcgaagtaatgaggcaacaaggagtaaacccggatgtatttgactatcaaatcataatggattcactttgtaaaatgggtaggatggatgctgctctggacaaatttaatcagatggtcaatcaaggagtttcacctaacaaagctgtttaccaatgcctggttctgggttcttgctctcatggtgattttgtgaaagccaaggaattgatttctgaagcggttaatagaggtctgtgttctaacagtgtgttcttctatcctgtaataaacgacctttgcaaagaaggaaaggtaaaggaggcacaggatatgtttgacttcatcctaggtattggtcagcggcctgatgtgattatgtacacttcactgatggatggatattgccttgttggcaaggtggagaaagcactgagtgtactcgatgctatgaaatttgctggccttcaacctgatgatgttgtatatggtacacttcttaacagttactgtaaaattggaaggattgccgatggattgagccttttcagggaaatgtcactcagcggggttaagcccacgactattatatacaacattatactggatgggctgttttgctctgggagaacaggttctgcaaaggaaaaattccatacaatgactgaaagtggcataccagtaggcgttgacacatacaacatagttcttagtggactttgtagaaacaattgcactgatgaagcaatagaactgttcaagaaactacgtgcaacgaacgtgaagattgatgtcatgacactcaatatcatgatttctgcaatgtttaaaactaggagaattgaagaagccaaggatttgtttgctactatatcagccatcggattggtgccttctgttgtgacttacagtttaatgatgacgaatttcataaaagaagggttgttggcagacgctgatgatacctttttggtaatggagaaagctggctgtgctcccaactccagtctgctaaatcaggtggtcagggtgttgctggaaaaaggtgcagttttaaaggctgcaacttatctcgctaaacttgatgctaaacagctgtcagttgaagtttcaacgatttcgttaatagtatctctcttctcaggggaagggaaactaagggagcatgtagagttgcttccagtaaagtaccagcctcctcagagttcggctgacaat

SEQ ID NO: 1895 - DNA, 2361 bp, Triticum aestivum
atgcctcgcttctcctccagcacgccaatgtcgccaccccgcctccgcctccgactctgcgcccgccactcctcctccacctctcatccctcacgcatctgggatccccacgccgccttcgccgccgcgacgcagcgggcgcactctggcaacctcaccccggaggacgcacaccatctgttcgacgaattgctgcggcagggcaatcctgtccaggagcgtcccttgaataactttctggctaccctcgcccgcgcgcccgcgtctgcatcctgcagtgatggccccgccctggccgttgccctctttggccgtttgtccggaggcgccggacgacgggtggcgcagccaaatgtgttcacctatggcgtcctcatggactgctgctgccgcgcgtgccgcacggatctggcgctcgctttcttcggccgtctcttcaggacgggcctggaggcaaaccaagtcatcttctgcaccctcctcaagggactctgccacgcaaagcgcacagatgaggctctggacgtgctgcttcacaggatgcctgagctgggctgcactccctatgtggtggcatataacaccgtcatccatggcttctttagggaaggccaagtaggcaaggcgtgcgatctgttccatggaatggcgcagcagggcgttatgcctgatgtggtgacatataactcagttatcgatgcgttgtgcaaggccagagcaatggacaaggcagagtatttccttcgtcagatggttgataatggtgtcgtacctaatactgtcacatataatagcctcatccatggatattcctcttcaggccattggaaggaggcggtcagggtattcaaagagatggcaagtcagagggttacagcagatgtgcatacttacaacatgtttatgacttttctttgcaaacatggaagaagcaaagaagctgcaggaatttttgataccatggctatcaagggcctgaaacctgataacgtttcatatgctattcgccttcatgggtatgccaccgaaggatgcttagttgatatgattaatctcttcaattcaatggaaagagattgtattctacctgactgtcgtatcttcaacatactgattaatgcatatgctaaatctgggaagcttgataaggctatgcttatcttcaatgaaatgcagaaacaaggagtgagtccaaatgcagtcacatattcaactgtaatagatgcattttgcaaaaagggtcagttggacgatgctatgataaagtttaatcagatgattgatacaggagtaccacagggcacagctgtttatggttctctaatccagggtttttgtacacacggcaatttggtgaaagcaaaggaattgcttactgaaatgatgaacaaaggtatacctcctcctgatattaagttcttccattcaatcatgcagaacctttgcacagaaggaagggtaatagaagcacatgatgtccttggcttgatagcgcacataggtatgaggcctaatgtttgcacatttaatatactgagcggtggatattgcctagtcggcaagatggaggatgcctcaaagatatttgatgatatgatgtcatatggcttagaaccttctaatatgacgtatggtatacttattaatggctattgcaaaaacgaaaggattaacgatgggttgattctgttcaaagaaatgttgcgcaagggacttaaacctacaacttttaattacaacgtcatactggatggattatttctaactggacgaactgttgctgcaaaggaaaagtttgatgagatggttgaatctggagtaagtgtgtgcattgatacatattcgatagttcttggtggactttgtagaaataattgtagcggcgaagcaatcatgctattccagaaattaagcacaatggatgtgaaattcaatattacaattgtcaatataatgattgatgccttctacagggttcagcgaaaccaagaagccaaggatttgtttgctgcagtatcagccaatggtttggtagctgatgtctttacctacaccataatgatgaaaaatcttataaaagaagggtcagtggaagaagctgacgatctctttttatcaatggagaagagcggctgtactgctgactcttatatgttaaatcttatcgtcagaatgttactggaaaaaggagagctagtcaaggctgggaattatatgtctaaagttgatgcaatgagctactcacttgaagctgaaaccgtttcgctgcttatctctctcttttcagggaaagggaaatatagagaacacataggattgctccctacaaagtatcggtttcatgaagaagcagccacagtt

SEQ ID NO: 1896 - DNA, 2361 bp, Triticum aestivum
atgcctcgcttctcctccagcacgccaatgtcgccaccccgcctccgcctccgactctgcgcccgccactcctcctccacctctcatccctcacgcatctgggatccccacgccgccttcgccgccgcgacgcagcgggcgcgctctggcaacctcaccccggaggacgcacaccatctgttcgacgaattgctgcggcagggcaatcgtgtccaggaacgtcccttgaataactttctggctaccctcgcccgcgcgcccgcgtctgcatcctgcagtgatggccccgccctggccgttgccctctttggccgtttgtccggaggcgccggacgacgggtggcgcagccaaatgtgttcacctatggcgtcctcatggactgctgctgctgcgcgtgccgcacggatctggcgctcgccttcttcggccgtctcctcaagacgggcctggaggcagaccaagtcgtcttctgcaccctcctcaagggcctttgccacgcaaagcgggcagatgaggctctggacgtgctgcttcacaggatgcctgagctgggctgcactccctatgtggtggcgtataacaccgtcatccatggcttctttagggaaggccaagtaggcaaggcgtgcaatctattccatgaaatgaggcagcagggcgttacacctgatgttgtgacatataacacagttattgatgcgttgtgcaaggccaaagcaatggacaaggcagagtatttccttggtcagatggttgatgatggtgtcgtacctgataatgtgacatataatagccttatccatggatattcctcttcaggccattcaaaggaggcggtcagggtgctgaaagagatgacaagtaagggtatcataccagatgtttttacttgcaactcgctcatggcctccctttgcaagaatggaagaagcaaagaagctgcagaaatatttgattcaatgtccatgaagggcctgaaacctaacaccgtttcatatgctattctccttcatgggtatgccattgaaggatgcttggttgacatgatcaatctcttcaattcaatggcaacagactgtattctacctaactgtcatatcttcagcatactgattaatgcatatgctaaatctgggaagcttgataaggctatgcttatcttccatgaaatgcagaaacaaggagtgagtccaaatgcagtcacatattcaactgtaatagatgcattttgcaaaaagggtcagttggacgatgctatgataaagtttaatcagatgattgatacaggagtacgacagggcacagctgtttatggttctctaatccagggtttttgtacacacggcgatttggtgaaagcaaaggaattgcttactgaaatgatgaacaaaggtatacctcctcctgatattaagttcttccattcaatcatgcagaaccttggcacagaaggaagggtaatagaagcacgggatgtccttggcttgatagcgcacataggtatgaggcctaatgtttgcacatttaatatactgatcggtggatattgcctagtcggcaagatggaggatgcctcaaaaatatttgatgatatgatgtcatatggcttagaaccttctaatattacgtatggtatacttattaatggctattgcaaaaacgaaaggattaacgatgggttgattctgttcaaagaaatgttgcgcaagggacttaaacctacaacttttaattacaacgtcatactggatggattatttctgactggacgaactgttgctgcaaaggaaaagtttgatgagatggttgaatctggagtaagtgtgtgcattgatacatattcgatagttcttggtggactttgtaaaaataattgtagcggcgaagcaatcacgctattccagaaattaagcacaatggatgtgaaattcaatattacaattgtcaatataatgattgatgccttctacagggttcagcgaaaccaagaagccaaggatttgtttgctgcagtatcagccaatggtttggtagctaatgtctttacctacaccataatgatgaaaaatcttataaaagaagggtcagtggaagaagctgacgatctctttttatcaatggagaagagcggctgtactgctgactcttatatgttaaatcttatcgtcagaatgttactggaaaaaggagagctagtcaaggctgggaattatatgtctaaagttgatgcaatgagctactcacttgaagctgaaaccgtttcgctgcttatctctctcttttcagggaaagggaaatatagagaacacataggattgctccctacaaagtatcggtttcatgaagaagcagccacagtt

SEQ ID NO: 1897 - DNA, 2337 bp, Triticum aestivum
atgtcgccaccccgtctccgcctccgactctgcgctcgccactcctcctccacctctcatccctcacgcatctgggatccccacgccgccttcgccgccgccacggaacgtgcgcactctggcaacctcacccccgaggacgcacaccacctgtttgacgaattgctgcggcaggccaatcctgtccaggagcgccccctcaacaaccttcttgccgccctcgcccgtgctccggcgtccgcggcgtgcagcgatggccctgcactcacagtcaatctcttcagccgcatatcccaaggcgcccgccgacgtgtggcgcacccaacggcctgcacctatggcatcctcatggactgctgctgccgcgcacaccgcctcgatctggcgttcgctttcttcggctgtctcctcaggacgggacttaaggcaggcgtcattcaagtttgcactcttctcaagggcctttgccgcgcaaagcgggctgatgaggctctggacatgctgcttcacaggatgcctgagctgggctgcacccccaacgtggtggcatataccacggtcatccacggcttctttaaggaaggccaagtaggcaaggcatgcaatctgttccatggaatggcgcagcagggcgttatgcctgatgtggtgacatataactcagttatcgatgcgctgtgcaaggccagagcaatggacaaggcagagtatttccttcgtcagatggttgataatggtgtcgtacctaataatgtcacatataatagcctcatccatggatattcctcttcaggccattggaaggaggcggtcagggtattcaaagagatgacaagtcggagggttacagcagatgtgcatacttacaacatgtttatgacctttctttgcaaacatggaagaagcaaagaagctgcaggtatttttgataccatggctatgaagggcctgaaacctgacaacgtttcatatgctattcgccttcatgggtatgccaccgaaggatgcttagttgatatgattaatctcttcaattcaatggaaagagactgtattctacctgactgttatatcttcaacatactgattaatgcatatgctaaatctgggaagcttgataaggctatgcttatcttcaatgaaatgcagaaacaaggagtgagtccaaatgcagtcacatattcaactgtaatagatgcattttgcaaaaagggtcagttggacgatgctatgataaagtttaatcagatgattgatacaggagtacgacagggcacagctgtttatcgttccctaatccagggattttgtacacacagcgatttggtgaaagcaaaggaattgcttactgaaatgatgaacaaaggtatacctcctcctgatattaagttcttccattcaatcatgcagaacctatgcacagaaggaagggtaatagaagcacgggatatccttggcttgatagcacacataggtatgaggcctaatgtttgcacatttaatatactgattggtggatactgcctagtcggcaagatggaggatgcctcaaaaatatttgatgatatgatgtcatatggtttagaaccttgtaacattacgtatggtatacttattaatggctattgcaaaaatagaaggattgatgacgggcttattctgttcaaagagatgctgcacaagggacttaaacctacaacctttaattataacgtcatactggatggattatttctggttggacgaactgttgctgcaaaggaaaagtttgacgagatggttgaatctggagtatgtgtgtgcattgatacatattcgatagttcttggtggactttgtagaaataattgtagcggcgaagcaatcacgctattccagaaattaagcacaatggaagtgaaattcaatattacaattgtcaatataatgattgatgctttctacaaggttcagcgaaaccaagaagccaaggatttgtttgctgcagtatcagccaatggtttggtagctgatgtctttacctacaccagaatgatgaaaaatcttataaaagaagggtcagtggaagaagctgacgatctctttttatcaatggagaagagcggctgtactgctgactcttatatgttaaatcttatcgtcagaatgtttctgggaaaaggagagatagtcaaggctgggaattatatatctaaaattgatgcaaagagctactcacttgaagctaaaactgtttcgctgcttatctctctcttttcagggaaagggaaatatagagaacacataggattgctccctgcaaagtatcggtttcgtgaagaagcagccacagttgtg

SEQ ID NO: 1898 - DNA, 2337 bp, Triticum aestivum
atgtcgccaccccgcctccgcctccgactctgcgcccgccactcctcctccacctctcatccctcacgcatctgggatccccacgccgccttcgccgccgccacggaacgtgcgcactctggcaacctcacccccgaggacgcacaccacctgtttgacgaattgctgcggcaggccaatcctgtccaggagcgccccctcaacaaccttcttgccgccctcgcccgtgctccggcgtccgcggcgtgcagcgatggccctgcactcacagtcaatctcttcagccgcatatcccaaggcgcccgccgacgtgtggcgcacccaacggcctgcacctatggcatcctcatggactgctgctgccgtgcacaccgcctcgatctggcgttcgctttcttcggctgtctcctcaggacgggacttaaggcaggcgtcattcaagtttgcactcttctcaagggcctttgccgcgcaaagcgggctgatgaggctctggacatgctgcttcacaggatgcctgagctgggctgcacccccaacgtggtggcatataccacggtcatccacggcttctttaaggaaggccaagtaggcaaggcatgcaatctgttccatggaatggcgcagcagggcgttatgcctgatgtggtgacatataactcagttatcgatgcgctgtgcaaggccagagcaatggacaaggcagagtatttccttcgtcagatggttgataatggtgtcgtacctaataatgtcacatataatagcctcatccatggatattcctcttcaggccattggaaggaggcggtcagggtattcaaagagatgacaagtcggagggttacagcagatgtgcatacttacaacatgtttatgacctttctttgcaaacatggaagaagcaaagaagctgcaggaatttttgataccatggctatgaagggcctgaaacctgacagcgtttcatatgctattcgccttcatggatatgccaccgaaggatgcttagttgatatgattaatctcttcaattcaatggaaagagattgtattctacctgactgtcgtatcttcaacatactgattaatgcatatgctaaatctgggaagcttgataaggctatgcttatcttcaatgaaatgcagaaacaaggagtgagtccaaatgcagtcacatattcaactgtaatagatgcattttgcaaaaagggtcagttggacgatgctatgataaagtttaatcagatgattgatacaggagtacgacagggcacagctgtttatcgttccctaatccagggattttgtacacacagcgatttggtgaaagcaaaggaattgcttactgaaatgatgaacaaaggtatacctcctcctgatattaagttcttccattcaatcatgcagaacctatgcacagaaggaagggtaatagaagcacgggatatccttggcttgatagcacacataggtatgaggcctaatgtttgcacatttaatatactgattggtggatactgcctagtcggcaagatggaggatgcctcaaaaatatttgatgatatgatgtcatatggtttagaaccttgtaacattacgtatggtatacttattaatggctattgcaaaaatagaaggattgatgacgggcttattctgttcaaagagatgctgcacaagggacttaaacctacaacctttaattataacgtcatactggatggattatttctggctggacgaactgttgctgcaaaggaaaagtttgacgagatggttgaatctggagtaagtgtgtgcattgatacatattcgatagttcttggtggactttgtagaaataattgtagcggcgaagcaatcacgctattccagaaattaagcacaatggaagtgaaattcaatattacaattgtcaatataatgattgatgctttctacaaggttcagcgaaaccaagaagccaaggatttgtttgctgcagtatcagccaatggtttggtagctgatgtctttacctacaccagaatgatgaaaaatcttataaaagaagggtcagtggaagaagctgacgatctctttttatcaatggagaagagcggctgtactgctgactcttatatgttaaatcttatcgttagaatgtttctgggaaaaggagagatagtcaaggctgggaattatatatctaaaattgatgcaaagagctactcacttgaagctaaaactgtttcgctgcttatctctctcttttcagggaaagggaaatatagagaacacataggattgctccctgcaaagtatcggtttcgtgaagaagcagccacagttgtg

SEQ ID NO: 1899 - DNA, 2337 bp, Triticum aestivum
atgtcgccaccccgcctccgcctccgactctgcgcccgccactcctcctccacctctcatccctcacgcatctgggatccccacgccgccttcgccgccgccacggaacgtgcgcgctctggcaacctcacccccgaggacgcacaccacctgtttgacgaattgctgcggcaggccaatcctgtccaggagcgccccctcaacaaccttcttgccgccctcgcccgtgctccggcgtccgcggcgtgcagcgatggccctgcactcacagtcaatctcttcagccgcatatcccaaggcgcccgccgacgtgtggcgcacccaacggcctgcacctatggcatcctcatggactgctgctgccgcgcacaccgcctcgatctggcgttcgctttcttcggctgtctcctcaggacgggacttaaggcaggcgtcattcaagtttgcactcttctcaagggcctttgccgcgcaaagcgggctgatgaggctctggacatgctgcttcacaggatgcctgagctgggctgcacccccaacgtggtggcatataccacggtcatccacggcttctttaaggaaggccaagtaggcaaggcatgcaatctgttccatggaatggcgcagcagggcgttatgcctgatgtggtgacatataactcagttatcgatgcgctgtgcaaggccagagcaatggacaaggcagagtatttccttcgtcagatggttgataatggtgtcgtacctaataatgtcacatataatagcctcatccatggatattcctcttcaggccattggaaggaggcagttagggtattcaaagagatgacaagtcggagggttacagcagatgtgcatacttacaacatgtttatgacctttctttgcaaacatggaagaagcaaagaagctgcaggaatttttgataccatggctatgaagggcctgaaacctgacagcgtttcatatgctattcgccttcatggatatgccaccaaaggatgcttagttgatatgattaatctcttcaattcaatggaaagagattgtattctacctgactgtcgtatcttcaacatactgattaatgcatatgctaaatctgggaagcttgataaggctatgcttatcttcaatgaaatgcagaaacaaggagtgagtccaaatgcagtcacatattcaactgtaatagatgcattttgcaaaaagggtcagttggacgatgctatgataaagtttaatcagatgattgatacaggagtacgacagggcacagctgtttatcgttccctaatccagggattttgtacacacagcgatttggtgaaagcaaaggaattgcttactgaaatgatgaacaaaggtatacctcctcctgatattaagttcttccattcaatcatgcagaacctatgcacagaaggaagggtaatagaagcacgggatatccttggcttgatagcacacataggtatgaggcctaatgtttgcacatttaatatactgattggtggatactgcctagtcggcaagatggaggatgcctcaaaaatatttgatgatatgatgtcatatggtttagaaccttgtaacattacgtatggtatacttattaatggctattgcaaaaatagaaggattgatgacgggcttattctgttcaaagagatgctgcacaagggacttaaacctacaacctttaattataacgtcatactggatggattatttctggctggacgaactgttgctgcaaaggaaaagtttgacgagatggttgaatctggagtaagtgtgtgcattgatacatattcgatagttcttggtggactttgtagaaataattgtagcggcgaagcaatcacgctattccagaaattaagcacaatggaagtgaaattcaatattacaattgtcaatataatgattgatgctttctacaaggttcagcgaaaccaagaagccaaggatttgtttgctgcagtatcagccaatggtttggtagctgatgtctttacctacaccagaatgatgaaaaatcttataaaagaagggtcagtggaagaagctgacgatctctttttatcaatggagaagagcggctgtactgctgactcttatatgttaaatcttatcgtcagaatgtttctgggaaaaggagagatagtcaaggctgggaattatatatctaaaattgatgcaaagagctactcacttgaagctaaaactgtttcgctgcttatctctctcttttcagggaaagggaaatatagagaacacataggattgctccctgcaaagtatcggtttcgtgaagaagcagccacagttgtg

SEQ ID NO: 1900 - DNA, 690 bp, Triticum aestivum
  misc_feature (512)..(512): n is a, c, g, or t
  misc_feature (612)..(612): n is a, c, g, or t
atggacaagttcaatgagatgactgatatgggttttcagccggacacaactgtttatcactccctaattcagggtttttgtatgcatggtgatttggttaaagctaaggggctggtttctgaaatgatgaacaaaggtattcctcgtcctgacattgcgttcttcaattcaataataaacactctatgcaaagaaggaggagttatggatgcacaagatgtctttgacttggttactgccatagatgagaggcctaatatcattacatttaattcactgattgatggatattgcttagttggcgagatggataaagcatttggagtacttgatgccatgaaatcagttggtgctgagcctgatattgttacatacaacacgcttgttaatggctattgtagaaatggaaggatcgatgatggtttgactctgttcagggaaatgccacataagagaataaaacctgacactgttacatatggcatcatactagatgggttgtttcatgctgnaagaactgtcgttgcaaggaaaatgttccatgagatgatcgaaagtgaaacracagtggacattcccgtatacaatayaatacttaaarrcctttttagntgtatcacatacaacctttcctcattaaaatcgtcgaggaaacaatgttttgacatcctatctgcaagatttcataaa

SEQ ID NO: 1901 - DNA, 963 bp, Triticum aestivum
atggacaagttcaatgagatgactgatatgggttttcagccggacacaactgtttatcactccctaattcagggtttttgtatgcatggtgatttggttaaagctaaggggctggtttctgaaatgatgaacaaaggtattcctcgtcctgacattgcgttcttcaattcaataataaacactctatgcaaagaaggaggagttatggatgcacaagatgtctttgacttggttactgccatagatgagaggcctaatatcattacatttaattcactgattgatggatattgcttagttggcgagatggataaagcatttggagtacttgatgccatgaaatcagttggtgctgagcctgatattgttacatacaacacgcttgttaatggctattgtagaaatggaaggatcgatgatggtttgactctgttcagggaaatgccacataagagaataaaacctgacactgttacatatggcatcatactagatgggttgtttcatgctgcaagaactgtcgttgcaaggaaaatgttccatgagatgatcgaaagtgaaacgacagtggacattcccgtatacaatataatacttaaaggcctttgtagaaataattgtgcagacgaagcgatcgccatgttccagaaattaggtgcaatgaatgtgaagtttgatattggaacactcaataccatgattaattcattgtacaaggttggaagaaaagaagaagctaaggatttgtttgctgcaatatcagccagcaggttggtgcctaatgcttctacttacagcataatgataataaattatctgaaggaaggatcagtggaagatgctaagcatatttttttcatcaatggacaagagtggtatagctcccagctctcgtcttataaactatatcatcagaatgttgtttttttgagaaaatatcatcagaatgttgttggaaaaagg

SEQ ID NO: 1902 - DNA, 627 bp, Triticum aestivum
atgaaatcagttggtgctgagcctgatattgttacatacaacacgcttgttaatggctattgtagaaatggaaggatcgatgatggtttgactctgttcagggaaatgccacataagagaataaaacctgacactgttacatatggcatcatactagatgggttgtttcatgctgcaagaactgtcgttgcaaggaaaatgttccatgagatgatcgaaagtgaaacgacagtggacattcccgtatacaatataatacttaaaggcctttgtagaaataattgtgcagacgaagcgatcgccatgttccagaaattaggtgcaatgaatgtgaagtttgatattggaacactcaataccatgattaattcattgtacaaggttggaagaaaagaagaagctaaggatttgtttgctgcaatatcagccagcaggttggtgcctaatgcttctacttacagcataatgataataaattatctgaaggaaggatcagtggaagatgctaagcatatttttttcatcaatggacaagagtggtatagctcccagctctcgtcttataaactatatcatcagaatgttgtttttttgagaaaatatcatcagaatgttgttggaaaaagg

SEQ ID NO: 1903 - DNA, 963 bp, Triticum aestivum; identical to SEQ ID NO: 1901

SEQ ID NO: 1904 - DNA, 522 bp, Triticum aestivum
atgccacataagagaataaaacctgacactgttacatatggcatcatactagatgggttgtttcatgctgcaagaactgtcgttgcaaggaaaatgttccatgagatgatcgaaagtgaaacgacagtggacattcccgtatacaatataatacttaaaggcctttgtagaaataattgtgcagacgaagcgatcgccatgttccagaaattaggtgcaatgaatgtgaagtttgatattggaacactcaataccatgattaattcattgtacaaggttggaagaaaagaagaagctaaggatttgtttgctgcaatatcagccagcaggttggtgcctaatgcttctacttacagcataatgataataaattatctgaaggaaggatcagtggaagatgctaagcatatttttttcatcaatggacaagagtggtatagctcccagctctcgtcttataaactatatcatcagaatgttgtttttttgagaaaatatcatcagaatgttgttggaaaaagg

SEQ ID NO: 1905 - DNA, 627 bp, Triticum aestivum; identical to SEQ ID NO: 1902

SEQ ID NO: 1906 - DNA, 627 bp, Triticum aestivum; identical to SEQ ID NO: 1902

SEQ ID NO: 1907 - DNA, 1962 bp, Triticum aestivum
atgccgagaagaagccggcccgcaggtggcatcctcatgggctgcttctgcggtgcgcatcgcccggacctagggcttgccttatttggccgcttcctcgggacaggcctcaagacaaacaagattgtggccaccaccttcctcaagtgcctctgctacgccaaacgtacagatgaggctgtcaacttgctgcttcgtaggatgcccgagcttggctgcgtgcctgatgcaatctcatacaccattgttctgaagagcttatgcgagaatagcatgagtcagcgggcacttgacctgctccagatggtggcagaaggaggaggtgcctgctccctcaatgtggtggtgtatagcacagtcatccatggcttcttcaaggagggcgaaacaggcaaggcatgcaatctattccatgaaatgatccatcaaggggttgtgcccaatgtggtcacgtatagctcgattattgatgcgttgtgcaaggccagagcaatggacaaggcagagctagtccttcaacagatggttgatagtggtgctcaaccaaataatgtgacatatacttgcatgatccatggatattccacatcagggcagttgaaagaggctgctaaaatgtttaggaaaatgacaacccggggtcttgtaccagatattgttacttgcagctcgttaatgactttcctttgcaagcatggaagaagcaaagaagcggcagaaattttttattccatgactgccaaaggcctcaaacctaatatcatcgcatactctattctgcttcacggatatgccaccgaaggatgctttgttgatatgaataatctctttaattcaatggaagacaatggtattgcagccaactgttatgttttcaacatattaatttatgcatatgctaaacgtggaatgatggatgaagctatgctcatatttaccgaaatgcgggaaaaaggagtgagtcccgatgtagtcacctattccactgtaatagccgcattttgcagattgcgtaggctggccaatgctatggacaagttcaatgagatgactgatatgggttttcagccggacacaactgtttatcactccctaattcagggtttttgtatgcatggtgatttggttaaagctaaggggctggtttctgaaatgatgaacaaaggtattcctcgtcctgacattgcgttcttcaattcaataataaacactctatgcaaagaaggaggagttatggatgcacaagatgtctttgacttggttactgccatagatgagaggcctaatatcattacatttaattcactgattgatggatattgcttagttggcgagatggataaagcatttggagtacttgatgccatgaaatcagttggtgctgagcctgatattgttacatacaacacgcttgttaatggctattgtagaaatggaaggatcgatgatggtttgactctgttcagggaaatgccacataagagaataaaacctgacactgttacatatggcatcatactagatgggttgtttcatgctgcaagaactgtcgttgcaaggaaaatgttccatgagatgatcgaaagtgaaacgacagtggacattcccgtatacaatataatacttaaaggcctttgtagaaataattgtgcagacgaagcgatcgccatgttccagaaattaggtgcaatgaatgtgaagtttgatattggaacactcaataccatgattaattcattgtacaaggttggaagaaaagaagaagctaaggatttgtttgctgcaatatcagccagcaggttggtgcctaatgcttctacttacagcataatgataataaattatctgaaggaaggatcagtggaagatgctaagcatatttttttcatcaatggacaagagtggtatagctcccagctctcgtcttataaactatatcatcagaatgttgttggaaaaagg

SEQ ID NO: 1908 - DNA, 1992 bp, Triticum aestivum
atgccgagaagaagccggcccgcaggtggcatcctcatgggctgcttctgcggtgcgcatcgcccggacctagggcttgccttatttggccgcttcctcgggacaggcctcaagacaaacaagattgtggccaccaccttcctcaagtgcctctgctacgccaaacgtacagatgaggctgtcaacttgctgcttcgtaggatgcccgagcttggctgcgtgcctgatgcaatctcatacaccattgttctgaagagcttatgcgagaatagcatgagtcagcgggcacttgacctgctccagatggtggcagaaggaggaggtgcctgctccctcaatgtggtggtgtatagcacagtcatccatggcttcttcaaggagggcgaaacaggcaaggcatgcaatctattccatgaaatgatccatcaaggggttgtgcccaatgtggtcacgtatagctcgattattgatgcgttgtgcaaggccagagcaatggacaaggcagagctagtccttcaacagatggttgatagtggtgctcaaccaaataatgtgacatatacttgcatgatccatggatattccacatcagggcagttgaaagaggctgctaaaatgtttaggaaaatgacaacccggggtcttgtaccagatattgttacttgcagctcgttaatgactttcctttgcaagcatggaagaagcaaagaagcggcagaaattttttattccatgactgccaaaggcctcaaacctaatatcatcgcatactctattctgcttcacggatatgccaccgaaggatgctttgttgatatgaataatctctttaattcaatggaagacaatggtattgcagccaactgttatgttttcaacatattaatttatgcatatgctaaacgtggaatgatggatgaagctatgctcatatttaccgaaatgcgggaaaaaggagtgagtcccgatgtagtcacctattccactgtaatagccgcattttgcagattgcgtaggctggccaatgctatggacaagttcaatgagatgactgatatgggttttcagccggacacaactgtttatcactccctaattcagggtttttgtatgcatggtgatttggttaaagctaaggggctggtttctgaaatgatgaacaaaggtattcctcgtcctgacattgcgttcttcaattcaataataaacactctatgcaaagaaggaggagttatggatgcacaagatgtctttgacttggttactgccatagatgagaggcctaatatcattacatttaattcactgattgatggatattgcttagttggcgagatggataaagcatttggagtacttgatgccatgaaatcagttggtgctgagcctgatattgttacatacaacacgcttgttaatggctattgtagaaatggaaggatcgatgatggtttgactctgttcagggaaatgccacataagagaataaaacctgacactgttacatatggcatcatactagatgggttgtttcatgctgcaagaactgtcgttgcaaggaaaatgttccatgagatgatcgaaagtgaaacgacagtggacattcccgtatacaatataatacttaaaggcctttgtagaaataattgtgcagacgaagcgatcgccatgttccagaaattaggtgcaatgaatgtgaagtttgatattggaacactcaataccatgattaattcattgtacaaggttggaagaaaagaagaagctaaggatttgtttgctgcaatatcagccagcaggttggtgcctaatgcttctacttacagcataatgataataaattatctgaaggaaggatcagtggaagatgctaagcatatttttttcatcaatggacaagagtggtatagctcccagctctcgtcttataaactatatcatcagaatgttgtttttttgagaaaatatcatcagaatgttgttggaaaaagg

SEQ ID NO: 1909 - DNA, 1992 bp, Triticum aestivum; identical to SEQ ID NO: 1908

SEQ ID NO: 1910 - DNA, 2364 bp, Triticum aestivum
atgcctcgtttctcctccaccacgtcaatgtcgtcactccgcctccgcctccacgcccgccactcctcctccgcctctcaaccctcacacagccagggatgggatccccacgccgccttcgccgccgcgacgcagcgtgcgcgctctggcagcctcaccccggcggacgcacaccacctgttcgacgaattgctgcggcaggccaatcctgtccaggagcgccccctcaacaaccttctcgccgccatcgcccgcgctccggcgtccaacgcctgcagaaacggccctgcactcgcggtcgccctcttcagccgcatatcccaaggcgcccgcctatgggtggtgcagccaacggcttgcacctacggcatcctcatggactgctgctgccgtgcacgccgccctgatctgtcactcgccttctttggccgtctcctcaagacgggcctggaggcaaaccaagtcgtcttcaacaccctcctcaagggcctttgccacacaaagcgggcggatgaggctctagacgtgctgctgcacaggatgcctgagctgggctgcacccccgacgtggtggcgtataacaccgttatccatggcttctttaaggagggccatgtaagcaaggcctgcaatctgttccatgaaatggcgcagcagggcgttaagcctaatgtggtgacatataactcagttatcgatgcgctgtgcaaggccagagccatggacaaggcagaggtggtccttcgtcagatgattgatgatggtgttggacctgataatgtgacgtatagtagcctcatccatggatattcctcttcaggccactggaaggaggcagttagggtattcaaagagatgacaagtcggagggttacaccaaatgtgcatacttacaacatgtttataacctttctttgcaaacatggaagaagcaaagaagctgcaggaatttttgattccatggctatgaagggcctgaaacctgacaacgtttcatatgctattctccttcatgggtatgccaccgaaggatgcttagttgatatgattaatctcttcaattcaatggaaagagattgtattctacctaactgtcgtatcttcagcatactgattaatgcctatgctaaatctgggaagcttgataaggcaatgcttatatttaaagaaatgcagaaacaaggagtgagtccagatgcattcacatattcaaccgtaatacatgcattttgcaaaaagggtaggttggatgatgctgtgataaagtttaatcagatgattgatacaggagtacgaccggacacggctgtttatcgttccctaatccagggattttgtacacatggcgatttggtgaaagcaaaggaatatgttactgaaatgatgaagaaaggtatgcttcctcctgatattatgttcttcagttcaatcatgcagaacctatgcacagaaggaagggtaacagaagcacgggatatccttgacttgatagtgcacattggtatgaggcctaatgttatcatatttaatttgctgatcggtggatactgcctagtccgcaagatggcagatgcattgaaagtatttgatgatatggtgtcatatggtttagaaccttgtaactttacgtatggtatacttattaatggctattgcaaaaatagaaggattgatgacgggcttattctgttcaaagagatgctgcacaagggacttaaacctacaacttttaattataacgtcatactggatggattatttctggctggacaaactgttgctgcaaaagagaagttcgatgagatggttgaatctggagtaagtgtgtgcattgatacatactctatagttcttggtggactttgtagaaatagctgcagtagcgaagcgatcacccttttccggaaattaagcgcaatgaatgtgaaatttgatattacaattgtcaatatcattattggtgccttatacagggtcgagagaaaccaagaggctaaggatttgtttgctgctatgccagccaatggcttggttcctaatgctgttacctacaccgtaatgatgacaaatcttataaaagaaggttcagtggaagaagctgacaatcttttcttatccatggagaagagcggctgtactgccaactcttgcctgttaaatcatatcatcagaaggttactggaaaaaggagagatagtcaaggctggaaattatatgtctaaagttgatgcaaagagctactcacttgaagctaaaactgtttcactgctgatctctctgttttcaaggaaagggaaatatagagaacacatcaaattgcttcctacaaagtatcagtttctggaagaagcagccacagttgaa

SEQ ID NO: 1911 - DNA, 2334 bp, Triticum aestivum
atgtccaacctccgcctcctacgccgcagctcctcctccatgtccaccaccaggtcgccactctcacgggtctggtccccccattcggcctttgccgcggccacagagcgcgtacgcaccgggacgctcagccaagacgatgcacaccacctgttcgacgaattgctgcggcagggcaatcctgtccaggagcgtcccttgaataactttctggctgccctcgcccgcgcgcccgcgtctgcatcctgcagcgatggccccgccctggccgtcgccctcttcggccgtttgtcccgaggcgccgggcaacgggtggcgcagccaaatgtgttcacctatggcgtcctcatggactgctgctgccgcgcttgccgcacagatctggcgctcgccttctttggccgtcttctcaggacgggcctgcaggcaggccaagtcgtcttcaacaccctcctcaagggcctttgccacacaaagcgggcggatgaggctctggacgtgcttcttcacaggatgcctgagctgggctgcacccccgatgtggtggcgtataacaccgtcatccatggcttctttagggaaggccaagtaggcaaggcatgcgatatgttccatggaatggcacagaagggtgttatgcctaatgtggtgacatataactcggttattgatgcgctgtgcaaggccagggccatggacaaagcagagacggtccttagtcaaatggtaaatgatggtgtccgacctgataacgtgacatataatagtctcattcatggatattcctctttgggcaattggaaggaggcggttagggtattcaaagagatgagtcggaggtttacaccagatgtcattacctgcacctcactcatggccttcctttgcaagaatggaaaaagcaaagaagctgcagaaatttttgattcaatggctatgaagggcctgaaacgtgacaccgtttcatatgctattctccttcatgggtatgccactgaaggatgcttggttgacatgattaatctcttcaattcaatggcaacagactgtattctacctaactgtcatatcttcaatatactgattaatgcatatgctaaatctggcatgatgggtgaggccatgcttatattcaaaaaaatgcacgaacaaggagtgagtccagatgtagtcacctattcaactgtaatacatgcattttgcaaaatgggtagcttggacattgctatggacaaatttaaccagatggttgatatgggagtacgaccgaatgcaattgtttatcattccctaatccagggtttttgtacacatggggatttagtgaaagcaaaggaattggttactgaaatgaggaacaaagctatgcgtcctcctgatattaagatcttccattcaataatgaagaacctatgcacggaaggaagggtaatagaagcacgggatatcctcgacttgatggtgcacataggtatgaggcctgatgttcccatctttaatttactgattggtggatactgcctagtccacaagatggaggatgcaacaaaaatgtttgatgatatggtgtcatatggtttagaaccttgtaacagtacgtatggtatacttattaatggctattgcaaaaacggaaggattgatgacgggctgaatctgttcaaagaaatgttgcgcaagggacttaaacctacaacttttaattacaacgtcatactggatggattatttctggctggacgaactgttgctgcaaaggaaaagtttgatgagatggttgaatctggagtaagtgtgtgcattgatacatattcgatagttcttggtggactttgtagaaataattgcaccggtgaagcaatcacgctgtccaagaaattaagtacaatgaatgtcaaattcaatattgcaattgtcaatatcttgattggtgcattcttcagggttcgacgaaaccaagaagctaaggatttgtttgccgcaataccagccaatggcttggtagctaatgttgttacctacagcatgatgatgataaatcttataaaagaagggtcactggaagaagctgacgatctctttttatcaatggagaagagcggctgtaccgctgactcttgtatgttaaatcatatcatcagaaggctactggaaagaggagagatagtcaaggctggaaattatatgtcgaaagttgatgcaaagagctactcacttgaagctaaaactgtttcgctgctgatctccctctttttagggaaagggagatatagagaacacatgaaattgctccctatgaagtatcagtttctcgaagaagcagccacagttgaa

SEQ ID NO: 1912 - DNA, 2370 bp, Triticum aestivum
atgcctcgcttctcctccaccacgcccatgtcgccactccgcctccgcctccgcctccgactcggcgcccgccactcctcctccacctcccattcctcacgcagctgggatccccactccgccttcgccgccgccgcggagcgtgcgcgctctggcaacctcaccccggaggacgcacaccacctgttcgacgaattgctccggcagggcaatcctgtccaggaccgccccttgaacaaacttctctccgccctcgcccgtgctccggcgtctgcggcctgtagaaacggccctgcactcgcggtcaacctcttcagccgcatatcccaaggtgcccgccgacgtgtggcggagccaacggcctgcacctacggcatcctcatggactgctgctgccgcgcacaccgcctcgatctgacgctggccttcttcggcggtctccttaagacgggacttaaggcaggcgtcattcaagtttgcactcttctcaagggcctctgccgcgcaaagcgggctgatgaggctctcgacgtgctgcttcacaggatgcctgagctgggctgcacccctgacgtggtggcatataccacggtcatccacggcttctttaaggaaggccaagtaggcaaggcatgcaatctgttccatggaatggcgcagcagggcgttgcgcctaatttggtgacatataactcggttattgatgcgttgtgcaaggccaaagcaatggacaaggcagagtatttccttggtcagatggttgatgatggtgtcgtacctgataatgtgacatataatagcctcatccatggatattcctcttcaggccactggaaggaggcagttagggtattcaaagagatgacaagtcggagggttacagcagatgtgcatacttacaacatgtttatgacctttctttgcaaacatggaagaagcaaagaagctgcaggaatttttgataccatggctatcaagggcctgaaacctgacaatgtttcatatgctattcgccttcatgggtatgccaccgaaggatgcttagttgatatgattaatctcttcaattcaatggaaagagattgtattctacctgactgtcgtatcttcagcatactgattaatgcatatgctaaatctgggaagcttgataaggctatgcttttatttaaagaaatgcagaaacaaggagtgagtccagatgcagtcacatattcaactgtaatagatgcattttgcaaaaagggtcagttggacgatgctatgataaagtttaatcagatgattgatacaggagtacgacagggcacagctgtttatggttctctaatccagggtttttgtacacacggcgatttggtgaaagcaaaggaattgcttactgaaatgatgaacaaaggtatacctcctcctgatattaagttcttccattcaatcatgcagaacctatgcacagaaggaagggtaatagaagcacaagatatccttgacctgatggtacacacaggtgagaggcctaatgttgtcacatttagtgtactggtcggtggatactgcctagtccgcaagatggcagatgcatcgaaagtatttgatgatatggtgtcatatggtttagaaccttgtaacattatgtatggaatacttattaatggctactgcaaaaatagaaggattgatgacgggcttattctgttcaaagagatgctgcacaagggacttaaacctacaacttttaattataacgtcatactgaatggattatttctggctggacaaactgttgctgcaaaagagaagtttgatgagatggttgaatctggagtaagtgtgtgcattggtacatactctatagttcttggtggactttgtagaaatggctgcagtagcgaagcgatcaccctgttccgaaaattaagcgcaatgaatgtgaaatttaatattacaattgtcaataccattattggtgccttctacagggtcgagagaaaccaagaggctaaggatttgtttgctgcagtatcagccaatggtttggtagctgatgtctttacctacaccataatgatgaaaaatcttataaaagaagggtcagtggaagaagctgacgatctctttttatcaatggagaagagcggctgtactgctgactcttatatgttaaatcttatcgtcagaatgtttctgggaaaaggagagatagtcaaggctgggaattatatatctaaaattgatgcaaagagctactcacttgaagctaaaactgtttcgctgcttatctctctcttctcagggaaagggaaatatagagaacacataggattgctccctgcaaagtatcggtttcgtgaagaagcagccacagttgtg

SEQ ID NO: 1913 - DNA, 2376 bp, Triticum aestivum
atgcctcgcttctcctccaccacgccaatgtcgccaccccgcctcctcctccggctcggcgcccgccactcctcctccacctctcatccctcacgcatctgggatccccacgccgccttcgccgctgcgacgcagcgggcgcgctctggcacgctcaccacggaggacgcacaccacctgtttgatgaattgctgcggcagggcaatcctgtccaggagcgtcccttgactaactttctggctgccctcgcccgcgcgcccgcgtccgcattctgcagcgatggccctgccctggccgtcgccctcttcggccgtttgtcccgaggcgccggacgacgggtggcgcagccaaatgtcttcacctatggcgtcctcatggactgctgctgccgtgcgcgccgcctggatctagcgatcgccttcttcgcccgtctcctcaagacgggactggaggcaaaccaagtcatcttctgcaccctcctcaagggactctgccacgcaaagcgctcagatgaggctttggacgtggtgcttcacaggatgcctgagctaggctgcacccccaacgtggtggcctataccacggtcatccacggcttcttgaaggaaggccaagtaggcaaggcatgcaatctattccatggaatggcgcagcagggcgttgcgcctgatgtggtgacatataactcggttatcgatgcgttgtgcaaggccagagcaatggacaaggcagagtatttccttcgtgaaatggttgataatggtgtcgtacctaataatgtgacatataatagcctcatccatggatattcctctttgggccatcagaaggaggctgttagggtgctgaaagaaatgacaagacagggtatcataccagatgtcattacctgcacctcactcatgaccttcctttgcaagaatggaaaaagcaaggaagctgcagaaatttttgattcaatggccacgaagggcctgaaacatgacgccgtttcatatgctattctccttcatgggtatgccactgaaggatgcttggttgatatgattaatctcttcaattcgatggacagagactgtattctacctaactgtcatatcttcaacatactgatttatgcatatgctaaatctgggaagcttgataaggctatgcttatatttagagatatgcagaaacaaggagtgagcccagatgcattcacatattcaaccttaatacatgcattttgtaaaaagggtcggttggacgatgctatgataaagtttaatcagatggttgatacaggagtacgacagggcacagctgtttatggttctctaatccagggtttttgtacacacggcgatttggtgaaaggaaaggaattggttactgaaatgatgaacaaaggtatacctcctcctgacattatgttcttccattcaatcatgcagaacctatgcacagaaggaagggtagtagaagcacgggatatccttggcttgatagcacacataggtatgaggcctaatgtttgcacatttaatatactgattggtggatactgcctagtccgcaagatggaggatgcctcaaaaatatttcatgatatgatgtcatatggtttagaaccttctaatgttacgtatggtattcttattaatggctattgcaaaaacagaaggattgatgacgggctgattctgttcaaagaaatgttgcgcaagggacttaaacctacaacttttaattacaacatcatactggatggattatttctggctggacgaactgttgctgcaaaggaaaagtttgatgagatggttgaatctggagtaagtatgtgcatcagtacttactctatagttcttcgtggactttgtagaaataattgtagcggcgaagccatcacgctattccagacattaagcgcaatggatgtgaaattcaatattagaattgtcaatatcatgattgatgccttcttcagggttcagcgaaagcaagaagctaaggatttgtttgctgcaataacagccaatgggttggttgctaatgtttttacctacagcctaatgatgacaaatcttataaaagaagggtcagtggaagaggctgacacactctttttatcgatggagatgagcggctgtacttcgaactcgtggatgttaaatcttattatcagagggttgctggaaaaaggagagatagtcaaggctggatgttatatgtctaaagttgatgcgaagagctactcacttgaagctaaaactgtttcgttgctgatctatctcttttcagggaaagggaaatacagagaacacataagattgctacctacaaagtatcagtttctcgaagaagcagccacagttgaatggtttgctata

SEQ ID NO: 1914 - DNA, 2376 bp, Triticum aestivum
atgcctcgcttctccaccaccacgccaatgtcgccaccccgcctcctcctccgactcggcgcccgccactcctcctccacctctcatccctcacgcatctgggatccccacgccgccttcgccgctgcgacgcagcgggcgcgctctggcacgctcaccacggaggacgcacaccacctgtttgatgaattgctgcggcagggcaatcctgtccaggagcgtcccttgactaactttctggctgccctcgcccgcgcgcccgcgtccgcattctgcagcgatggccctgccctggccgtcgccctcttcggccgtttgtcccgaggcgccggacgacgggtggcgcagccaaatgtcttcacctatggcgtcctcatggactgctgctgccgtgcgcgccgcctggatctagcgatcgccttcttcgcccgtctcctcaagacgggactggaggcaaaccaagtcatcttctgcaccctcctcaagggactctgccacgcaaagcgctcagatgaggctttggacgtggtgcttcacaggatgcctgagctaggctgcacccccaacgtggtggcctataccacggtcatccacggcttcttgaaggaaggccaagtaggcaaggcatgcaatctattccatggaatggcgcagcagggcgttgcgcctgatgtggtgacatataactcggttatcgatgcgttgtgcaaggccagagcaatggacaaggcagagtatttccttcgtgaaatggttgataatggtgtcgtacctaataatgtgacatataatagcctcatccatggatattcctctttgggccatcagaaggaggctgttagggtgctgaaagaaatgacaagacagggtatcataccagatgtcattacctgcacctcactcatgaccttcctttgcaagaatggaaaaagcaaggaagctgcagaaatttttgattcaatggccacgaagggcctgaaacatgacgccgtttcatatgctattctccttcatgggtatgccactgaaggatgcttggttgatatgattaatctcttcaattcgatggacagagactgtattctacctaactgtcatatcttcaacatactgatttatgcatatgctaaatctgggaagcttgataaggctatgcttatatttagagatatgcagaaacaaggagtgagcccagatgcattcacatattcaaccttaatacatgcattttgtaaaaagggtcggttggacgatgctatgataaagtttaatcagatggttgatacaggagtacgacagggcacagctgtttatggttctctaatccagggtttttgtacacacggcgatttggtgaaaggaaaggaattggttactgaaatgatgaacaaaggtatacctcctcctgacattatgttcttccattcaatcatgcagaacctatgcacagaaggaagggtagtagaagcacgggatatccttggcttgatagcacacataggtatgaggcctaatgtttgcacatttaatatactgattggtggatactgcctagtccgcaagatggaggatgcctcaaaaatatttcatgatatgatgtcatatggtttagaaccttctaatgttacgtatggtattcttattaatggctattgcaaaaacagaaggattgatgacgggctgattctgttcaaagaaatgttgcgcaagggacttaaacctacaacttttaattacaacatcatactggatggattatttctggctggacgaactgttgctgcaaaggaaaagtttgatgagatggttgaatctggagtaagtatgtgcatcagtacttactctatagttcttcgtggactttgtagaaataattgtagcggcgaagccatcacgctattccagacattaagcgcaatggatgtgaaattcaatattagaattgtcaatatcatgattgatgccttcttcagggttcagcgaaagcaagaagctaaggatttgtttgctgcaataacagccaatgggttggttgctaatgtttttacctacagcctaatgatgacaaatcttataaaagaagggtcagtggaagaggctgacacactctttttatcgatggagatgagcggctgtacttcgaactcgtggatgttaaatcttattatcagagggttgctggaaaaaggagagatagtcaaggctggatgttatatgtctaaagttgatgcgaagagctactcacttgaagctaaaactgtttcgttgctgatctatctcttttcagggaaagggaaatacagagaacacataagattgctacctacaaagtatcagtttctcgaagaagcagccacagttgaatggtttgctata

SEQ ID NO: 1915 - DNA, 2376 bp, Triticum aestivum; identical to SEQ ID NO: 1913

SEQ ID NO: 1916 - DNA, 2376 bp, Triticum aestivum; identical to SEQ ID NO: 1914

SEQ ID NO: 1917 - DNA, 2364 bp, Triticum aestivum
atgcctcgcttctcctccaccatgccaatgtcgccaccccacctcctcctccgactctgcgcccgccactcctcctccacctctcatccctcacgcatctgggatccccacgccgcctttgccgccgcgacgcagcgggcgcgctctggcacgctcaccacggaggacgcacaccacctgttcgacgaattgctgcggcagggcaatcctgtccaggagcgtcccttgactaactttctggctgccctcgcccgtgcgcccgcgtccgcatcctgcagcgacggccccgccctggccgtcgccctttttggccgtttgtctcgaggcgctggacgacgggtggcacagccaaatgtcttcacctatggcgtcctcatggactgctgctgccgtgcgcgtcgcctggatctagcgatcgccttcttcggtcgtctcctcaagacgggcctggaggcagaccgagtcgttttcagcaccctcctcaagggactctgccacgcaaagcgctcagatgaggctctggacgtgctgcttcacaggatgcctgagcagggatgcactccctatgtggtggcgtataacaccgtcatccatggcttctttagggaaggccaagtaggcaaggcgtgcgatctgttccatggaatggcacagcagggcgttatgcctgatgtggtgacatataactcggttatcgatgcgctgtgcaaggccagagcaatggacaaggcagagtatttccttcgtcagatggttgatgatggtgttgtacctaataatgtgacatataatagcctcatccatggatattcctcttcaggccattggaaggaggcaattagggtattcaaagagatgacaagtcggaggattacagcagatgtgcatacttacaatatgtttatgacctttctttgcaaacatggaagaagcgaagaagctgcaggaatttttgataccatggctatgaagggcctgaaacctgacaacgtttcatatgctattcgccttcatgggtatgccaccgaaggatgcttagttgatatgattaatctcttcaattcaatggaaagagactgtattctacctgactgttgtatcttcaacatactgattaatgcatatgctaaatctgggaagcttgataaggctatgcttatcttcaatgaaatgcagaaacaaggagtgagtccagatgcagtcacatatttacccgtaatagatgcattttgcaaaaagggtaggttggacgatgctatgattatgtttaatcagatgattgatacaggagtacgaccagccacagctgtttatacttccctaatccaaggtttttgtacacacggcgatttggtgaaagcaaaggaattggttactgaaatgatgaacaaaggtatacctcctcctgatattaagttcttccattcaatcatgcagaacctatgcacagaaggaagggtaacagaagcacgggatatccttggcttgatagcacacataggtatgaggcctaatgtttgcacatttaatatactgattggtggatactgcctagtccgcaagatgacagatgcatcgaaagtatttgatgatatggtgtcatatggtttagaaccttgtaactttacgtatggtatacttattaatggctattgcaaaaatagaaggattgatgacgggcttactctgttcaaagagatgctgcacaagggacttaaacctaaagcttttaattataacgtcatactggatggattatttctggctggacaaactgttgctgcaaaagagaagtttgatgagatggttgaatctggagtaagtgtgtgcattgatacatactctatagttcttggtggactttgtagaaatagctgcagtagcgaagcgatcaccctgttccgaaaattaagcgcaatgaatgtgaaatttgatattacaattgtcaataccattattggtgccttctatagggtcgagagaaaccaagaggctaaggatttgtttgctgctattccagccagtggcttggttccgaatgttgttacctataccataatgatgaaaaatcttataaaagaaggttcagtggaagaagctgacaatctttttttatcgatggagaagagcggctgtagtgccaactcttatctgttaaatcatatcatcagaaggttactggaaaaaggagagagagtcaaggctggaaattatatgtctaaagttgatgcaaagagctactcacttgaagctaaaactgtttcgctgctgatctctctgttttcaaggaaagggaaatatagagaacacatcaaattgcttcctacaaagtatcagtttctggaagaagcagccacagttgaa

SEQ ID NO: 1918 - DNA, 2226 bp, Triticum aestivum
atgtcgccgctccgcctccatgcccgccgctcctactccacctcgcatcccccacgcagccagggctgggatccccacgccgccttcgcagctgccacggagcgcgcgcgatctggcaacctcacctcggaggacgcacacaagctgttcgaccaattgctcctgcaggctaatccggtcaacatgcgccttcccaacgaccttctcaccgccctggctcgcgcgcctgcgtccgcagcctgcagcaacggccccgccctcgccgtcaccctcttcacccgtttgtcccgaggtgcccgccaaccggtggtgcagccaacggcctgcacctacggcatcctcatggactgctgctgccgcgcaaaccgtcaggatctggcgctcgccttcttcgcccgtctcctcaggacgggactcaaggcaggcgtcatagaagtcaacactcttctcaagggactctgccgcgcaaagcgggctgatgaggctctggacattctgcttcacaggatgcctgagcttggctgcacccccaacgtggtggcctataccacggtcatccacggcttcttgaaggaaggccaagtaggcaaggcatgcaatctattccatggaatggcgcagcagggcgttgcacctaatgtggtgacatataactcggttattgatgcgctgtgcaaggccagagccatggacaaggcagagtatttccttcgtcaaatggttgataatggtgtcgtacctgataatgtgacatataatagcctcatccatggatattcctcttcaggccattggaaggaggcggtaagggtgctgaaagaaatgacaagtcaaggtatcatacctgatatcgtttcataccgtattctgcttcatgggtatgccaccaaagggtgcttagttgatatgattaatctcttcaattcaatggcaagatactgtattctacctgattgtcatatcttcaacatactgattaatgcatatgctaaatctgggaagcttgataaggctatgcttatatttaaagaaatgcagaaacaaggagtgagtccagatgcagtcacatattcaaccgtaatacatgcattttgcaaaaatggcaggttggacgatgctgtgataaagtttaatcaaatgattgatacaggagtacaaccggacacatctgtttataatgccctaatccaggggttttctacaaatggcgatttggtgaaggcaaaggaattggttacggaaatgatgaacaaaggtatacctcctcctgatattaagttcttccattcaatcatgcagaacctatgcacagaaggaaggttaacagaagcacgggatatccttggcttgatagcacacataggtatgaggcctaatgtttgcacatttaatatactgattggtggatactgcctagtccgcaagatggcagatgcatcgaaagtatttgatgatatggtgtcatatggtttagaaccttgtaactttacgtatggtatacttattaatggctattgcaaaaatagaaggattgatgacgggcttattctgttcaaagagatgctgcacaagggacttaaacctacaacttttaattataacgtcatactggatggattatttctggctggacaaactgttgctgcaaaggaaaagtttaatgagatggttgaatctggagtaagtgtgtgcattgatacatactcgatagttcttggtggactttgcacaaataactgttgcggcgaagccatcacgctattccagaaattaagcacaatggaagtgaaattcgatattataattgtcaataccatgattgatgccttctacagggttcggcaaaaccaagaagctaaggatttgtttgctgcagtatcagccaatggtttggtagctaatgtctttacctacaccataatgatgacaaatcttataaaagaagggtcactggaagaagctgacaatctctttttatcaatggagaagagcggctgtactgctgactcttttatgttaaatcttatcattagaaggttactggaaaaaggagagatagtcaaggctggaaattatatttctaaagttgatgcaaagagctactcccttgaagctaaaactgtttcgcttcttatctctctcttttcagggaaagggaaatatagagcacacatcagattgctcccttcaaagtatcagtttcgtgaagaagcaggcacagttgaa

SEQ ID NO: 1919 - DNA, 861 bp, Triticum aestivum
atgaggcctaatgtttgcacatttaatatactgattggtggatactgcctagtccgcaagatggcagatgcatcgaaagtatttgatgatatggtgtcatatggtttagaaccttgtaactttacgtatggtatacttattaatggctattgcaaaaatagaaggattgatgacgggcttattctgttcaaagagatgctgcacaagggacttaaacctacaacttttaattataacgtcatactggatggattatttctggctggacaaactgttgctgcaaaggaaaagtttaatgagatggttgaatctggagtaagtgtgtgcattgatacatactcgatagttcttggtggactttgcacaaataactgttgcggcgaagccatcacgctattccagaaattaagcacaatggaagtgaaattcgatattataattgtcaataccatgattgatgccttctacagggttcggcgaaaccaagaagctaaggatttgtttgctgcagtatcagccaatggtttggtagctaatgtctttacctacaccataatgatgacaaatcttataaaagaagggtcactggaagaagctgacaatctctttttatcaatggagaagagcggctgtactgctgactcttttatgttaaatcttatcattagaaggttactggaaaaaggagagatagtcaaggctggaaattatatttctaaagttgatgcaaagagctactcccttgaagctaaaactgtttcgcttcttatctctctcttttcagggaaagggaaatatagagcacacatcagattgctcccttcaaagtatcagtttcgtgaagaagcaggcacagttgaa

SEQ ID NO: 1920 - DNA, 867 bp, Triticum aestivum
atgcagaaacaaggagtgagtccagatgcagtcacatattcaaccgtaatacatgcattttgcaaaaatggcaggttggacgatgctgtgataaagtttaatcaaatgattgatacaggagtacaaccgaacacatctgtttataatgccctaatccaggggttttctacaaatggcgatttggtgaaggcaaaggaattggttacggaaatgatgaacaaaggtatgcatcctcctgatattaaggtcttccattcggtaatgcagaacctatgcacagaaggaagggtaacagaagcacgggatatccttgacttgatagtgcacataggtatgaggcctgatgttttcacatttacttcactgatcggtggatactgcctagtccgcaacatggaggatgcatcaaaaatatttgatgatatggtgtcatatggtttagaaccttctaacatcacgtatggtatacttattaatggctattgcaaaaacaaaaggattgatgaggggctgattctgttcaaagaaatgttgcgcaagggacttaaacctacaactattaattacaatgtcatattggatggattatttctggctggacgaactgttgctgctaaggaaaagtttaatgagatggttgaatctggagtaagtgtgtgcattgatacatattcgatagttcttggtggactttgcacaaataactgttgcggcgaagccatcacgctattccagaaattaagcaaaatgaatgtgaaattcaatattagaattgtcaatatcatgattgatgccttcttcaaggttcagcgaaagcaagaagctgaggatttgtttgctgcaatatcagcaaatgggttggtttgc

SEQ ID NO: 1921 - DNA, 2307 bp, Triticum aestivum
atgccccgtcgtctcccacccgtcttgctcccacttcacaccaaggccatgcctcgcctctcctccaccacgcccatgtcgccactccgcctccgcctccgcctccgcgcccgccactccgcctccacctcccattcctcacgcagctgggagccccacgccgccttcgccgccgccacggagcgcgcgcgctcttgcaacctcaccccggaggacgcacaccacctgttcgacgaattgctgcggcaggccaaacctgtccaggagcgccccctcaacaaccttcttgccgccctcgcccgtgctccggcgtccgcggcgtgcagcgatggccctgcactcgcggtcaacctcttcggccgcatatcccaaggcgcccgccgacgtgtggcgcacccaacggcctgcacatacggcatcctcatggactgctgctgccgcgcacaccgcctcgatctggcgttcgctttcttcggccatctcctcaggacgggacttaaggcaggcgtcattcacgtttgcactcttctcaagggcctctgccgcgcaaagcgggctgatgaggctctcgacgtgctgcttcacaggatgcctgagctgggctgcactcccgatgtggtggcatataccacggtcatccacggcttctttaaggaaggccaagtaagcaaggcatgcaatctattccatgaaatggcgctgcagggcgttgcacctaatgtggtgacatatagctcggttattgatgcgctgtgcaaggccagagccatggacaaggcagagtatttccttcgtcagatggttcataatggtgtcctagctaataatgtgacatataatagcctcatccatggatattcctcttcaggccattggaaggaggcggttagggtgctgaaagaaatgacaagtcaaggtatcatacctgatatcgtttcataccgtattctgcttcatgggtatgccaccgaagggtgcttagttgatatgattaatctcttcaattcaatggcaagatactgtattctacctgattgtcatatcttcaacatactgattaatgcatatgctaaatctgggaagcttgataaggctatgcttatatttaaagaaatgcagaaacaaggagtgagtccagatgcagtcacatattcaaccgtaatacatgcattttgcaaaaatggcaggttggacgatgctgtgataaagtttaatcaaatgattgatacaggagtacaaccgaacacatctgtttataatgccctaatccaggggttttctacaaatggcgatttggtgaaggcaaaggaattggttacggaaatgatgaacaaaggtatgcatcctcctgatattaaggtcttccattcagtaatgcagaacctatgcacagaaggaagggtaacagaagcacgggatatccttgacttgatagtgcacataggtatgaggcctgatgttttcacatttacttcactgatcggtggatactgcctagtccgcaacatggaggatgcatcaaaaatatttgatgatatggtgtcatatggtttagaaccttctaacatcacgtatggtatacttattaatggctattgcaaaaacaaaaggattgatgaggggctgattctgttcaaagaaatgttgcgcaagggacttaaacctacaactattaattacaatgtcatattggatggattatttctggctggacgaactgttgctgcaaaggaaaagtttaatgagatggttgaatctggagtaagcgtgtgcattgatacatattcgatagttcttggtggactttgcacaaataactgttgcggcgaagccatcacgctattccagaaattaagcaaaatgaatgtgaaattcaatattagaattgtcaatatcatgattgatgccttcttcaaggttcagcgaaagcaagaagctgaggatttgtttgctgcaatatcagcaaatgggttggttgctaatgtttttacctacagcctaatgatgacaaatcttataaaagaagggtcagcggaagaagctgacactctctttttatcgatggagaagagcggctgtactgccaactcgtggatgttaaatcttattatcagaaggctactggaaaaaggagagatagtgaaggctggaaattatatggctaaagtcgatgcaaagagctactcacttgaagctaaaacggtttcgctgctgatttctctcttttcagggaaagggaaatacagagaacacataagattgctgcctacaaagtatcagtttcgtgaagaagcagccacagttgaa

SEQ ID NO: 1922 - DNA, 2349 bp, Triticum aestivum
atggctcgcctctgcttcaccacgcccatgccgcacctccgccgccgctactcctccttcacctcgcctccttcacgccgctgggacccccgacccgcctttgccgcagccacggagcgcgtccgcgccgggacgctcagccctgaagacgcacaccacctgttcgacgaattgctactgcaggccaaccccgtccccgagcgctccctcaacggcttccttgccgcgctcgcccgtgctccgtcctccgctactctcagagatggaccctcccttgctctcgccctcttcaaccgtgtctgccgagaagaagcaggaccgccggtggcgccgcccacagtccgcacctacaacatcctcatggacagctgctgccgtgcacgccgcccggacctaggccttgccttcttcggccgcttcctgagggcgggcctcaaggtaaacctgattgtcgccagcaccctactcaagtgcctctgccatgcaagacggacagatgaggctgtcaacatgctgcttcataggatgtccgagttcggttgtgtgcctgatgccatctcatactccatagtacttaagggcttatgtgacaatagcaggagccagcaagcgctcgatctgctccagatggtaaggaaaggaggtgcctgctccctcagtgtggtggcatatagcataatcatacatggcttctttaaggaaggggaagtaagcaaggcatgcaatctgttccatgaaatgatgcagcaaggggttgtaccagatgtggtcacatatagctccattattgatgcgctgtgcaaggtcagggcaatggacaaggcaaagttggtccttcagcagatggttaataatggtgttcgaccaaatatgtatacttggaactcattcatgtactccctgtgcaagcatggaagaagcaaagaagctgcagaattttttaactccatgaccgccaagggcctcaaacctgatattgtcgcgtactctactcttcttcacgggtatgctaccgaaggatgcctcaccgatatgattaatttctttaattcaatggaacgcaatggtattgtagccaactgcaaagttttcaccatattaattgatggatatgctaaatgtggaatgacagatgaagctatgctcatctttaccaaaatgcaagaacaaggagtaagtcctaatgtattcacctatgcaattgtaacagctgcactttgcagaatgggcaggctgtctgatgcaatggaaaaactaaatgagatgattgcaatgggcttacaaccgaacaaggttgtttatcactctctaattcaggtcttttgtacacatggtgatttggtgaaagcaaaggccttggtttctgaaatgatgaacaaaggtattcctcgtccaaacattgtgttcttcaactcagtaataaacagtctatgcaaggaaggaagagttacagatgcacacgatatcttcgacttggctataaacattggtgagaggcctgacgttattacatttaattcactgattgacggatattgtttagccgggaagatggataaagcattcggagtacttgatgccatggtttcatctggcattgagcccaatgttgtcacatacaatacacttgttggtggctattctagaaatggaaggattgatgatgggttgaccctattcagagaaatgatgcatatcaaaattaaacctacaactgcaacatatggcgccatacttcatgggttgtttcgtgctggcagaactttttctgcgaagaaaatgttcaatgagatgattgaaagtggaacaacagtgaacatttccatatatgctataattcttggaggactttgtagaaacaattgcgttgatgaagcaatcgtcttgttcgagaaattaggtgcaatgaatgtgaagttggatgttggaatattcaataccatgattaatgcaatgtacgcggttaagggaagagaagaagctgaggatttgtttgctgcaatatcagccaatgggttggtacctaatgcttcttcttacggtgttatgataacaaatcttctaagagaaggattagtggaagaagctgacaatatgttttcatcaatggacaagagtggttgtgctcctagctctcgtctgttaaataatatcatcagaatgttattggaaaaaggtgagatatctaaggctggaaattatatgtctaaagttgatggaaagaatatctcacttgaagcttcaactacttcactgctgctgtctctcttttcaagggaaggcaaatatcgggagcaaataaaattgctccctgccaagtatcaattttttgatggatccagccatagt

SEQ ID NO: 1923 - DNA, 2349 bp, Triticum aestivum; identical to SEQ ID NO: 1922

SEQ ID NO: 1924 - DNA, 2349 bp, Triticum aestivum; identical to SEQ ID NO: 1922

SEQ ID NO: 1925 - DNA, 2349 bp, Triticum aestivum; identical to SEQ ID NO: 1922

SEQ ID NO: 1926 - DNA, 2349 bp, Triticum aestivum; identical to SEQ ID NO: 1922

SEQ ID NO: 1927 - DNA, 2349 bp, Triticum aestivum; identical to SEQ ID NO: 1922

SEQ ID NO: 1928 - DNA, 2328 bp, Triticum aestivum
atgtcgccaccccgcctccgcctgcacgcccgccactcctcctccgcctcgcaaccctcacgcagccagggctgggatccccacgccgcattcgccgccgccgcggagtgcgcacgctctggcaacctcaccccggaggacgcacacaacctgttcgaccaattgctgcagcatggcaatcctgtccaggagcgcgcactcaacagccttctcgccgccctcgcccgcacgccggcgtccgcggcgtgccgcgacggccctgccctcacggtcgccctcttcagccgcatatccaaaggacgggtggcgcagccaaatgtcttcacctatggcgtcctcatggcggactgctgctgccgtgcacaccgcccggatctgacactagcgttcttcggccgtttcctcaggacgggcctggaggcagaccaagtcgtcttcaacaccctcctcaagggcctttgccatgcaatgcgggcaggtgaggccgtgaacgtgcttcttcacaggatgcctgacctgggctgcactcccaatgtggtggcgtataacaccgtcatccatggcttctttagggaaggccaagcaggcaaggcatgcgatatgttccatggaatggcacagaagggcgttatgcctaatgtggtgacatataactcggttattgatgcactgtgcaaggccagggccatggacaaagcagagacggtccttagtcaaatggtaaatgatggtgtccgacctgataacgtgacatataatagtctcatccatggttattcctctttgggcaattggaaggaggcggttagggtattcagagagatgagtcagaggtttacaccagatgtcgttacctgcacctcactcatggccttcctttgcaagaatggaaaaagcaaagaagctgcagaaatttttgattcaatggccaccaagggcctgaaacgtgacaccgtttcatatgctattctccttcatgggtatgccaccgaaggatgcttggttgatatggataatctcttcaattcaatggtaagaggctgtattgtaccggactgtcatatcttcaacatactgattgatgcatatgctaaatctgagaagcttgataaggctatgcttatgtttaaagaaatgcagaaacatggagtgagtccaaatgcagtcacatatccaaccgtaatacatgcattttgcaaaatgggtagcttggacattgctatggacaaatttaaccagatggttgatatgggagtacgaccgaatgcaattgtttatcattccctaatccagggtttttgtacacatggggatttagtgaaagcaaaggaattggttactgaaatgaggaacaaagctatgcgtcctcctgatattaagttcttccattcaataatgcagaacctatgcacggaaggaagggtaatagaagcacgggatatcctcgacttgatgctgcacataggtatgaggcctgatgttcccatctttaatttactgatcggtggatactgcctagtccgtgagatggaggatgcaacaaaaatgtttgatgatatgatgtcatatggtttagaaccttgtaacaatacgtatggtatacttattaatggctattgcaaaaacggaaagattgatgatgggctgaatctgttcaaagagatgctgcacaagggacttaaacctacaacttttaattataacgtcatactggatggattatttctggctggacgaactgttgctgcaaaggtgaagtttaatgagatggttgaatctggagtaagtgtgtgcattgatacatactctatagttcttggtggactttgtagaaataattgcaccggtgaagcaatcacgctgtccaagaaattaagtacaatgaatgtcaaattcaatattgcaattgtcaatatcttgattggtccattcttcagggttcggcgaaaccaagaagctaaggatttgtttgccgcaataccatccaatggcttggtagctaatgttgttacctacagcataatgatgacaaatcttgtaaaagaagggtctgtggaagaagctgacactctctttttatcaatggagaagagcgggtgtactgccaactcttgtatgttaaatcatataatcagaaggttactggaaaaaggagagatagtcaaggctcgaaattatatgtcgaaagttgatgcaaagagctactcacttgaagctaaaactgtttcgctgctgatctccctcttttcagggaaagggaaatatagagaacgcaaaaaattgctccctatgaagtatcagtttctcgaagaagcagccacagttgaa

SEQ ID NO: 1929 - DNA, 969 bp, Triticum aestivum
atgcttcctcctgatattgcattcttcaattcaatcatgcagaacctttgcacagaaggaagggtaatagaagcacgggatgtccttggcttgatagcgcacataggtatgaggcctgatgtttgcacatttaatatactgatcggtggatactgcctagtcggcaagatggaggatgcctcaaaaatatttgatgatatgatgtcatatggcttagaaccttctaatattacgtatggtatacttattaatggctattgcaaaaatagaaggattgatgacgggcttattctgttcaaagagatgctgcacaagggacttaaacctacaacttttaattataacgtcatactggatggattatttctggctggacgaactgttgctgcaaaggaaaagtttgatgagatggttgaatctggagtaagtgtgtgcattggtacatattcgatagttcttggtggactttgtagaaataattgtagtggcgaagcaatcacgctattccagaaattaagcacaatggatgtgaaattcaatattacaattgtcaatataatgattgatgccttctacagggttcagcgaaaccaagaagccaaggatttgtttgctgcagtatcagccaatggtttggtagctaatgtttttacctacaccataatgatgaaaaatcttataaaagaagggtcagtggaagaagctgacgatctctttttatcaatggagaagagcggctgtactgctgactcttatatgttaaatcttatcgtcagaatgttactggaaaaaggagagctagtcaaggctgggaattatatgtctaaagtagatgcaatgagctactcacttgaagctgaaaccgtttcgctgcttatctctctcttttcggggaaagggaaatatagagaacacataggattgctccctgcaaagtatcggtttcgtgaagaagcagccacagttgtg

SEQ ID NO: 1930 - DNA, 1989 bp, Triticum aestivum
atggactgttgctgccgcgcacaccgcctcgatctggcgttcgctttcttcggccgtctcctcaggacgggacttaaggcaggcgtcattcaagtttgcactcttctcaagggcctctgccgcgcaaagcgggctgatgaggctctcgacgtgctgcttcacaggatgcctgagctgggctgcactcccgatgtggtggcatataccacggtcatccacggcttctttaaggaaggccaagtaggcaaggcatgcaatctgttccatggaatggcgcagcagggcgttgcgcctaatttggtgacatataacttggttattgatgcgttgtgcaaggccaaagcaatggacaaggcagagtatttcctcggtcagatggttgatgatggtgtcgtacctgataatgtgacatataatagcctcatccatggatattcctcttcaggccactggaaggaggcagttagggtattcaaagagatgacaagtcggagggttacagcagatgtgcatacttacaacatgtttatgacctttctttgcaaacatggaagaagcaaagaagctgcaggaatttttgataccatggctatgaagggcctgaaacctgacaacgtttcatatgctattctccttcatgggtatgccaccgaaggaagcttagttgatatgattaatctcttcaattcaatggaaagagactgtattctacctgactgttgtatcttcaacatactgattaatgcatatgctaaatctgggaagcttgataaggctatgcttatcttcaatgaaatgcagaaacaaggagtgagtccaaatgcagtcacatattcaaccataatacatgcattttgcaaaaattgtaggttggacgatgctgtgataaagtttaatcagatgattgatacaggagtacgacagggcacagctgtttatcgttccctaatccagggtttttgtacacacggcgatttggtgaaagcaaaggaattgcttactgaaatgatgaacaaaggtatgcttcctcctgatattgcattcttcaattcaatcatgcagaacctttgcacagaaggaagggtaatagaagcacgggatgtccttggcttgatagcgcacataggtatgaggcctgatgtttgcacatttaatatactgatcggtggatactgcctagtcggcaagatggaggatgcctcaaaaatatttgatgatatgatgtcatatggcttagaaccttctaatattacgtatggtatacttattaatggctattgcaaaaatagaaggattgatgacgggcttattctgttcaaagagatgctgcacaagggacttaaacctaaaacttttaattataacgtcatactggatggattatttctggctggacgaactgttgctgcaaaggaaaagtttgatgagatggttgaatctggagtaagtgtgtgcattggtacatattcgatagttcttggtggactttgtagaaataattgtagtggcgaagcaatcacgctattccagaaattaagcacaatggatgtgaaattcaatattacaattgtcaatataatgattgatgccttctacagggttcagcgaaaccaagaagccaaggatttgtttgctgcagtatcagccaatggtttggtagctaatgtttttacctacaccataatgatgaaaaatcttataaaagaagggtcagtggaagaagctgacgatctctttttatcaatggagaagagcggctgtactgctgactcttatatgttaaatcttatcgtcagaatgttactggaaaaaggagggctagtcaaggctgggaattatatgtctaaagtagatgcaatgagctactcacttgaagctgaaaccgtttcgctgcttatctctctcttttcggggaaagggaaatatagagaacacataggattgctccctgcaaagtatcggtttcgtgaagaagcagccacagttgtg

SEQ ID NO: 1931 - DNA, 1032 bp, Triticum aestivum
atggactgttgctgccgcgcacaccgcctcgatctggcgttcgctttcttcggccgtctcctcaggacgggacttaaggcaggcgtcattcaagtttgcactcttctcaagggcctctgccgcgcaaagcgggctgatgaggctctcgacgtgctgcttcacaggatgcctgagctgggctgcactcccgatgtggtggcatataccacggtcatccacggcttctttaaggaaggccaagtacgcaaggcatgcaatctgttccatggaatggcgcagcagggcgttgcgcctaatttggtgacatataacttggttattgatgcgttgtgcaaggccaaagcaatggacaaggcagagtatttcctcggtcagatggttgatgatggtgtcgtacctgataatgtgacatataatagcctcatccatggatattcctcttcaggccactggaaggaggcagttagggtattcaaagagatgacaagtcggagggttacagcagatgtgcatacttacaacatgtttatgacctttctttgcaaacatggaagaagcaaagaagctgcaggaatttttgataccatggctatgaagggcctgaaacctgacaacgtttcatatgctattctccttcatgggtatgccaccgaaggaagcttagttgatatgattaatctcttcaattcaatggaaagagactgtattctacctgactgttgtatcttcaacatactgattaatgcatatgctaaatctgggaagcttgataaggctatgcttatcttcaatgaaatgcagaaacaaggagtgagtccaaatgcagtcacatattcaaccataatacatgcattttgcaaaaagggtaggttggacgatgctgtgataaagtttaatcagatgattgatacaggagtacgacagggcacagctgtttatcgttccctaatccagggtttttgtacacacggcgatttggtgaaagcaaaggaattgcttactgaaatgatgaacaaaaggtatgcttcctcc

SEQ ID NO: 1932 - DNA, 2364 bp, Triticum aestivum
atgcctcgcttctcctccaccacgccaatgtcgccaccccgcctcctcctccggctccgcgcccgccactcctcctccacctctcatccctcacgcatctgggatccccacgctgccttcgccgccgccacggaacgtgggcgctctggcaacctcaccccggaggacgcacaccacctgttcgacgaattgctctggcagggcaatcctgtccaggaccgccccttgaacaaacttctctccgccctcgcccgtgctccggcgtccgcggcctgcagaaacggccctgcactcgcggttgccctcttcagccgcatatcccaaggtgcccgccgacgggtggcggagccaacggcctgcacctacggcatcctcatggactgctgctgccgcgcacaccgcctggatctggcgctcgccttcttcgcccgtctcctcaagacgggcctggaggcaaaccaagtcatcttcaacaccctcctcaagggactctgccacgcaaagcgctcagatgaggctctggacgtgctgcttcacaggatgcctgagctgggctgcacccccggcgttgtggcgtataacacggtcatccatggcttcttcaaggaaggccaagtaggcaaggcgtgcaatctattccatgaaatggtgcagcagggtgttatgcctgatgtggtgacatataactcggttaccgatgcgctgtgcaaggccagaggaatggacaaggcagagtatttccttcgtcaaatggttgatgatggtgtcgtacctgatactgtgacttataatagcctcatccatggatactcctcttcaggccactggaaggaggcagttagggtattcaaagagatgacaagtcggagggttacaccagatgtgcatacttacaacatgtttataacctttctttggaaacatggaagaagcaaagaagctgcaggaatttttgattccatggctatgaagggcctgaaacctgacaacgtttcatatgctattctccttcatgggtatgccaccgaaggatgcttagttgatgtgattaatctcttcaattccatggcaacagactgtattctacctaactgtcatatcttcaacatactgattaatgcatatgctaaatctgggaagcttgataaggctatgcttatatttagagaaatgcagaaacaaggagtgagcccagatgcattcacatattcaaccttaatacatgcattttgtaaaaagggtcggttggacgatgctatgataaagtttaatcagatggttgatacaggagtacgacagggcacagctatttatggttctctaatccagggtttttgtacacacggcgatttggtgaaaggaaaggaattggttactgaaatgatgaacaaaggtatacctcctcctgatattatgttcttccattcaatcatgcagaacctatgcacagaaggaagggtaatagaagcacgggatatccttggcttgatagcgcacataggtatgaggcctaatgtttgcacatttactatactgatcggtgggtactgcctagtctgcaagatggaggatgcaacaaaaatgtttgaggatatggtgtcatttggtttagaaccttgtaatattacgtatggtatacttattaatggctattgcaaaaatagaaggattgatgatgggcttattctgttccaagagatgctgcacaagggacttaaacctacaacttttaattataatgtcatactggatgggttatttctggctggacgaactgttgctgcaaaggaaaagtttgatgagatggttgaatctggagtaagtgtgtgcactgatacatattcgatagttcttgctggactttgcagaaataattgctctagcgaagtaatcatgctgttccagaaattaagggcaatgaacatggaattcaatattagaattgtcactatcatgattgatgccttctacaaggttcggcgaaaccaagaagctaaggatttgtttgctgcaataccatccaatggcttggtagctaatgttgttacctacagcataatgatgaaaaatcttataaaagaaggttcagtggaagaagctgacactctctttttatcaatggagaagagcggctgtactgcaaccccttggatgttaaatcatattatcagaaggttactggaaagaggagagatagtcaaggctggaaattatatgtcgaaagttgatgcaaagagctactcacttgaagctaaaactgtttcgctgctgatctccctcttttcagggaaagggaagtatagagaacacataaaattgctccctatgaagtatcagtttctcgaagaagcagccacagttgaa

SEQ ID NO: 1933 - DNA, 2355 bp, Triticum aestivum
atgtcgccactccgcctccgcctccgcctccggccccgcctccatgcccgccactcctactccacctcgcatcccccacgcggccagggctgggatccccacgcctccttcgcagctgccacggagcgcgcgcgatctggcaacctctcctcggaggacgcacaccacctgttcgaccaattgctcctgcaggctaatccggtcaacatgcgccttccgaacgaccttctcaccgccctggctcgcgcacctgcgtccgcatcctgcagcaacggccccgccctcgccgtcgccctcttcagccgtttgtcccaaggtgcccgccaacgggtggtgcagccaacggcctgcacctacggcatcctcatggactgctgctgccgcgcaaaccgccaggatctggcgctcgccttcttcgcccgtctcctcaggacgggactcaaggcaggcgtcatagaagtcaacactcttctcaagggactctgccgtgcaaagcgggctgatgaggctctggacattctgcttcacaggatgcctgagctaggctgcacccccaacgtggtggcatataacacggtcatccatggcttcttccaagaaggccaagcaggcaaggcgtgcagcttgttccatgaaatggcgcagcagggcgttgcgcctagtttggtgacatataactcggttattgatgcgctgtgcaaggccagagccatggacaaggcagagtatttccttggtcagatggttgatgatggtgtcatacctgataatgtgacatataatagcctcatccatggatattcctcttcaggccactggaaggaggcagttagggtattcaaagagatgacaagtcggagggttaaaccaaatgtgcatactcacaacatgtttatgacctttctttgcaaacatggaagaagcaaagaagctgcaggaatttttgataccatggctatgaagggcctgaaacataacaacgtttcatatgctattctccttcacgggtatgccaccgaaggatgcttagttgatatgattaatctcttcaattcaatggaaagatactgcattctacctgactgtcgtatcttcaacatactgattcatgcacatgctaaatctgggaagcttgataaggccatgcttatcttcaatgaaatgcagaaacaaggagtgagtccaaatgcagtcacatattcaaccataatacatgcattttgcaaaaagggtaggttggacgatgctgtgataaagtttaatcagatgattgatacaggagtacgacagggcacagctgtttatcgttccctaatccagggtttttgtacacacggcgattcggtgaaagcaaaggaattgctcactgaaatgatgaacaaaggtatgcttcctcctgatattgcattcttcaattcaatcatgcagaacctttgcacagaaggaagggtaatagaagcacgggatgtccttggcttgatagcgcacataggtatgaggcctgatgtttgcacatttaatatactgatcggtggatactgcctagtcggcaagatggaacatgcctcaaaaatatttgatgatatgatgtcatatggcttagaaccttctaatattacgtatggtatacttattaatggctattgcaaaaatagaaggattgatgacgggcttattctgttcaaagagatgctgcacaagggacttaaacctacaacttttaattataacgtcatactggatggattatttctggctggacgaactgttgctgcaaaggaaaagtttgatgagatggttgaatctggagtaagtgtgtgcattggtacatattcgatagttcttggtggactttgtagaaataattgtagcggcgaagcaatcacgctattccagaaattaagcacaatggatgtgaaattcaatattataattgtcaatataatgattgatgctttctacaaggttcagcgaaaccaagaagccaaggatttgtttgctgcagtatcagccaatggtttggtagctaatgtctttacctacaccataatgatgaaaaatcttataaaagaagggtcagtggaagaagctgacgatctctttttatcaatggagaagagcggctgtactgctgactcttatatgttaaatcttatcgtcagaatgttactgggaaaaggagagatagtcaaggctgggaattatatatctaaaattgatgcaaagagctactcacttgaagctaaaactgtttcgctgcttatctctctcttttcagggaaagggaaatatagagaacacataggattgctccctgcaaagtatcggtttcgtgaagaagcagctacagttgtg

SEQ ID NO: 1934 - DNA, 984 bp, Triticum aestivum
atgatgaagaaaggyatgcttcctcctgatattaarttcttcmattcaatcatgcagaacctttgcacagaaggaagggtaatagaagcacgggatgtccttggcttgatagcgcacataggtatgaggcctgatgtttgcacatttaatatactgatcggtggatactgcctagtcggcaagatggarsatgcctcaaaaatatttgatgatatgatgtcatatggcttagaaccttctaatattacgtatggtatacttattaatggctattgcaaaaatagaaggattgatgacgggcttattctgttcaaagagatgctgcacaagggacttaaacctacaacttttaattataacgtcatactggatggattatttctggctggacgaactgttgctgcaaaggaaaagtttgatgagatggttgaatctggagtaagtgtgtgcattggtacatattcgacagttcttggtggactttgtagaaataattgtagcggcgaagcaatcacgctattccagaaattaagcacaatggatgtgaaattcaatattataattgtcaatataatgattgatgctttctacaaggttcagcgaaaccaagaagccaaggatttgtttgctgcagtatcagccaatggtttggtagctaatgtctttacctacaccataatgatgaaaaatcttataaaagaagggtcagtggaagaagctgacgatctctttttatcaatggagaagagcggctgtactgctgactcttatatgttaaatcttatcgtcagaatgttactgggaaaaggagagatagtcaaggctgggaattatatatctaaaattgatgcaaagagctactcacttgaagctaaaactgtttcgctgcttatctctctcttttcagggaaagggaaatatagagaacacataggattgctccctgcaaagtatcggtttcgtgaagaagcagccacagttgtg

SEQ ID NO: 1935 - DNA, 2355 bp, Triticum aestivum; identical to SEQ ID NO: 1933

SEQ ID NO: 1936 - DNA, 2376 bp, Triticum aestivum
atgccccgcttctcctccaccacgccaatgtcgccaccccgcctcctcctccgactccgcgcccgccactcctcctccacctctcatccctcacgcatctgggatccccacgccgccttcgccgctgcgacgcagcgggcgcgctctggcacgctcaccacggaggacgcacaccacctgttcgacgaattgctgcggcagggcaatcctgtccaggagcgtcccttgaataactttctggctgccctcgcccgcgcgcccgcgtccgcatcctgcagcggtggccccgccctggccgttgccctcttcggccatttgtcccgaggcgccggacgacgggtggcgcagccaaatgtcttcacctatggcgtcctcatggactgctgctgccgtgcgtgccgcccggatctggcgctcgccttcttcggccgtctcctcaagacgggcctggaggcagaccaagtcgtcttcagcaccctcctgaagggcctttgccacgcaaagcgggcggatgaggctctggacgtgctgcttcacaggatgactgagctgggctgcacccccaacgtggtggcgtataacacggtcatccatggcttctttagggaaggccaagtaggcaaggcgtgcgctctgttccatggaatggcgcagcagggcgttacacctgatgtggtgacatataactcggttattgatccgctgtgcaaggccaaagcaatggacaaggcagagtatttcctttgtcagatggttgataatggtgccgtacctaataatgtgacatataatagcctcatccatggatattcctcttcaggccattcaaaggaggcggtcagggtgctgaaagagatgacaagtaagggtatcataccagatgtttttacttgcaactcgctcatggcctccctttgcaagaatggaagaagcaaagaagctgcagaaatatttgattcaatgtccatgaagggcctgaaacctaacaccgtttcatatgctattcgccttcatgggtatgccaccgaaggatgcttaattgatatgattaatctcttcaattcaatggaaagagactgtattctacctgactgtcatatcttcagcatactgattaatgcatatgctaaatctgggaagcttgataaggctatgcttatattcaaaaaaatgcggaaacaaggagtgagtccaaatgcagtcacatattcaaccgtaatagatgcattttgtaaaaagggtcggttggatgatgctgtgatagagtttaatcagatgattgatacaggagtacgaccgaacacggctgtttattgttccctaatccagggtttctgtacacatggcggtttggtgaaagcaaaggaatatgttactgaaatgatgaacaaaggtatgcttcctcctgatattatgttcttccattcagtaatgcagaacctatgcacagaaggaagggtaatagaagcacgggatatccttggcttgatagcgcacataggtatgacgcctgatgcttgcacatttaatatactgattggtggatactgcctagtctgcaagatggaggattcaacaaacatgtttaatgatatggtgtcatatggtttagaaccttgtaacattacgtatggtatacttattaatggctattgcaaaaatagaaggattgatgaggggctgattctgttcaaagagatgttgcgcaagggacttaaacctacaacttttaattataacgtcatcttggatggattatttctggctggacgaactgttgccgcaaaggaaaagtttaatgagatggttgaatctggagtaagtatgtggatcagtacttactctatagttcttcgtggactttgtagaaataattgtagcggcgaagccatcacgctattccagaaattaagcgcaatggatgtgaaattcaatattagaattgtcaatatcatgattgatgccttcttcagggttcagcgaaagcaagaagctaaggatttgtttgctgcaataacagccaatgggttggttgctgatgtttttacctacagcctaatgatgacaaatcttataaaagaagggtcagtggaagaggctgacacactctttttatcgatggagatgagcggctgtacttcgaactcgtggatgttaaatcttattatcagaaggttgctggaaaaaggagagatagtcaaggctggatgttatatgtctaaagttgatgcgaagagcttctcacttgaagctaaaactgtttcactgctgatctctctcttttcagggaaagggaaatacagagaacacataagattgctacctacaaagtatcagtttctcgaagaagcagccacagttgaatggtttgctaca

SEQ ID NO: 1937 - DNA, 2376 bp, Triticum aestivum; identical to SEQ ID NO: 1936

SEQ ID NO: 1938 - DNA, 2376 bp, Triticum aestivum; identical to SEQ ID NO: 1936

SEQ ID NO: 1939 - DNA, 2376 bp, Triticum aestivum; identical to SEQ ID NO: 1936

SEQ ID NO: 1940 - DNA, 2376 bp, Triticum aestivum; identical to SEQ ID NO: 1936

SEQ ID NO: 1941 - DNA, 2376 bp, Triticum aestivum; identical to SEQ ID NO: 1936

SEQ ID NO: 1942 - DNA, 2313 bp, Triticum aestivum
atgccaaccgcccgcctgtcctccatcttcacctcctccttcagggatccttcacgagcccccctcgccgccttggctgccgccacggaacgcgtgcgcgctggaacgctaacccgggaggacgcgcaccacctgttcggcgaattgctaggccaagccgccgccgtcccggaacgcgggttgaacaactttcttgccacactcgcccgtgctccaccctcacctgcctgcagcgatggccccggccttgccatcgccctcttcaaccgcatgtcccgaggcgctggtgcacgggtggtgtcgcccacgctctgtacctattccatcctcatggactgctgctgccgcgcaggccgcccggacttggtggttgccttcttcggtcgcctcatcaggttggggctgcgcttggaggtcatctccgtcagcaatctcctcaaggggctctgccaggccaagcgtacaaatgaggcggtggccttgctgctccacgggacacctgaactggactgtgtgcctaatgtcttctcgtacagcatcgtaatcaacggctgttttaaagaaggtgaagtagacaaagcgtgcaatctcttccatgggatgatccaactgggagttcaacctaatgtggtcatctacacctcaattatcgatgcactaagcaagtgcagagccatggacaaggcagaagtggtccttcagcaaatggttgatcaaggcattgaacccaacatcaggacatatactaccctgatacatggatattccgcttcgggtcagtggaaggcggcagttagagtattcaaggaaatggcaagtgttggtgttctaccaaatgctgtcactttgaactcatttatggattcactttgcaagcatagaaggacaaaggaagctagagttatttttgactccatggctgcaaagggccaaaaacctgatgtcgtctcctactctactatgcttagcgggtatgcgaaagaaggatgcttcgatgatatgacttgtctcttcaattcgatgctacagaatggtgttgtacctaaccaccatattttcaacatactgatcaatgcatatgctaaacgtggactgatggatgcggctatgcacatgttcgaagtaatgaggcaacaaggagtaaacccagatgtatttagctatcaaattgtaatggattcactttgcaaaatgggtaggatggatgctgctctggacaaatttaatcagatggtcaatcaaggagtttcacctgacatagttgtttaccgatgcctagttctgggttcttgctctcatggtgattttgagaaagccaaggaattgatttctgaagcagttaatagaggtctgtgttctaacagtgtgttcttctatcctgtaataaacgacctgtgcaaagaaggaaaggtgaaggaggcacaggatatgtttgacttcattgtaggtattggtcagcggcctgatgtgattatgtacaattcactgatggatggatattgccttgttggcaaagtggaggaagcactgagagtacttgatgctatgaagtctgttggcctccaacctgatgcttttacgtacggtatacttcttaatggctactgtaaaattggcaagatcgccgatggattgagtcttttcagggaaatgtcactcaacggggttaagcccatgactattatgtacaacattatactccatgggttgtttttctccgggagaacagtttctgcaaaggaaatattccatacgatgaatgcaagtggcataccagtgggcgttgacacatacaacatagttcttagtggactttgtaaaaataattgcactgatgaagcaatagagctgttcaagaaattacgtgctatgaacgtgaagattaatgtcataatactcaataccatgatttctgcaatgtttaaaactaggagaattgaagaagccaaggatttgtttgctactatatcagccattgggttggtgccttctgttgtgacttacagtgtaatgatgacgaatttcataaaagaagggttgttggcagaggctgatgatatgtttttagcaatggagaaggctagctgtgctcccaactccagtctgctaaatcaagtggtcagggcgttgctggaaaaaggtgcagttgtaaaggctgcaacttatctcgctaaacttgatgctaaacagctgtcagttgaagcttcaacgatttcgttaatagtatctctcttctcaggggaagggaaactaagggagcacgtagagttgcttccagtaaagtaccagcctcctgagagttcggctgacaat

SEQ ID NO: 1943 - DNA, 2313 bp, Triticum aestivum; identical to SEQ ID NO: 1942

SEQ ID NO: 1944 - DNA, 1002 bp, Triticum aestivum
atgccaaccgcccgcctgtcctccatcttcacctcctccttcagggatccttcacgagcccccctcgccgccttggctgccgccacggaacgcgtgcgcgctggaacgctaacccgggaggacgcgcaccacctgttcggcgaattgctaggccaagccgccgccgtcccggaacgcgggttgaacaactttcttgccacactcgcccgtgctccaccctcacctgcctgcagcgatggccccggccttgccatcgccctcttcaaccgcatgtcccgaggcgctggtgcacgggtggtgtcgcccacgctctgtacctattccatcctcatggactgctgctgccgcgcaggccgccaggacttggtggttgccttcttcggtcgcctcatcaggttggggctgcgcttggaggtcatctccttcagcaatctcctcaaggggctctgccaggccaagcgtacaaatgaggcggtggccttgctgctccacgggacacctgaactggactgtgtgcctaatgtcttctcgtacaacatcataatcaacggctgttttaaagaaggtgaagtagacaaagcgtgcaatctcttccatgggatgatccaactgggagttcaacctaatgtggtcatctacacctcaattatcgatgcactaagcaagtgcagagccatggacaaggcagaagtggtccttcagcaaatggttgatcaaggcattgaacccaacatcaggacatatactaccttgatacatggatattccgcttcgggtcagtggaaggcggcagttagagtattcaaggaaatggcaagtgttggtgttctaccaaatgctgtcactttgaactcatttatggattcactttgcaagcatatagaaggacaaaggaagctagagttatttttgactccatggctgcaaagggccaaaaacctgatgtcgtctcctactctactatgcttagcgggtatgcgaaagaaggatgcttcgatgata

SEQ ID NO: 1945 - DNA, 2313 bp, Triticum aestivum; identical to SEQ ID NO: 1942

SEQ ID NO: 1946 - DNA, 1083 bp, Triticum aestivum
atggtcaatcaaggagtttcacctgacatagttgtttaccgatgcctagttctgggttcttgctctcatggtgattttgagaaagccaaggaattgatttctgaagcagttaatagaggtctgtgttctaacagtgtgttcttctatcctgtaataaacgacctgtgcaaagaaggaaaggtgaaggaggcacaggatatgtttgacttcattgtaggtattggtcagcggcctgatgtgattatgtacaattcactgatggatggatattgccttgttggcaaagtggaggaagcactgagagtacttgatgctatgaagtctgctggcctccaacctgatgcttttacgtacggtatacttcttaatggctactgtaaaattggcaagatcgccgatggattgagtcttttcagggaaatgtcactcaacggggttaagcccacgactattatgtacaacattatactccatgggttgtttttctccgggagaacagtttctgcaaaggaaatattccatacgatgaatgcaagtggcataccagtgggcgttgacacatacaacatagttcttagtggactttgtaaaaataattgcactgatgaagcaatagagctgttcaagaaattacgtgctatgaacgtgaagattaatgtcatagtactcaataccatgatttctgcaatgtttaaaactaggagaattgaagaagccaaggatttgtttgctactatatcagccattgggttggtgccttctgttgtgacttacagtgtaatgatgacgaatttcataaaagaagggttgttggcagaggctgatgatatgtttttagcaatggagaaggctagctgtgctcccaactccagtctgctaaatcaagtggtcagggcgttgctggaaaaaggtgcagttgtaaaggctgcaacttatctcgctaaacttgatgctaaacagctgtcagttgaagcttcaacgatttcgttaatagtatctctcttctcaggggaagggaaactaagggagcacgtagagttgcttccagtaaagtaccagcctcctgagagttcggctgacaat

SEQ ID NO: 1947 - DNA, 2313 bp, Triticum aestivum; identical to SEQ ID NO: 1942

SEQ ID NO: 1948 - DNA, 2313 bp, Triticum aestivum
atgccaaccgcccgcctgtcctccatcttcacctcctccttcagggatccttcacgagcccccctcgccgccttggctgccgccacggaacgcgtgcgcgctggaacgctaacccgggaggacgcgcaccacctgttcggcgaattgctaggccaagccgccgccgtcccggaacgcgggttgaacaactttcttgccacactcgcccgtgctccaccctcacctgcctgcagcgatggccccggccttgccatcgccctcttcaaccgcatgtcccgaggcgctggtgcacgggtggtgtcgcccacgctctgtacctattccatcctcatggactgctgctgccgcgcaggccgcccggacttggtggttgccttcttcggtcgcctcatcaggttggggctgcgcttggaggtcatctccgtcagcaatctcctcaaggggctctgccaggccaagcgtacaaatgaggcggtggccttgctgctccacgggacacctgaactggactgtgtgcctaatgtcttctcgtacagcatcgtaatcaacggctgttttaaagaaggtgaagtagacaaagcgtgcaatctcttccatgggatgatccaactgggagttcaacctaatgtggtcatctacacctcaattatcgatgcactaagcaagtgcagagccatggacaaggcagaagtggtccttcagcaaatggttgatcaaggcattgaacccaacatcaggacatatactaccctgatacatggatattccgcttcgggtcagtggaaggcggcagttagagtattcaaggaaatggcaagtgttggtgttctaccaaatgctgtcactttgaactcatttatggattcactttgcaagcatagaaggacaaaggaagctagagttatttttgactccatggctgcaaagggccaaaaacctgatgtcgtctcctactctactatgcttagcgggtatgcgaaagaaggatgcttcgatgatatgacttgtctcttcaattcgatgctacagaatggtgttgtacctaaccaccatattttcaacatactgatcaatgcatatgctaaacgtggactgatggatgcggctatgcacatgttcgaagtaatgaggcaacaaggagtaaacccagatgtatttagctatcaaattgtaatggattcactttgcaaaatgggtaggatggatgctgctctggacaaatttaatcagatggtcaatcaaggagtttcacctgacatagttgtttaccgatgcctagttctgggttcttgctctcatggtgattttgagaaagccaaggaattgatttctgaagcagttaatagaggtctgtgttctaacagtgtgttcttctatcctgtaataaacgacctgtgcaaagaaggaaaggtgaaggaggcacaggatatgtttgacttcattgtaggtattggtcagcggcctgatgtgattatgtacaattcactgatggatggatattgccttgttggcaaagtggaggaagcactgagaatacttgatgctatgaagtctgttggcctccaacctgatgcttttacgtacggtatacttcttaatggctactgtaaaattggcaagatcgccgatggattgagtcttttcagggaaatgtcactcaacggggttaagcccatgactattatgtacaacattatactccatgggttgtttttctccgggagaacagtttctgcaaaggaaatattccatacgatgaatgcaagtggcataccagtgggcgttgacacatacaacatagttcttagtggactttgtaaaaataattgcactgatgaagcaatagagctgttcaagaaattacgtgctatgaacgtgaagattaatgtcataatactcaataccatgatttctgcaatgtttaaaactaggagaattgaagaagccaaggatttgtttgctactatatcagccattgggttggtgccttctgttgtgacttacagtgtaatgatgacgaatttcataaaagaagggttgttggcagaggctgatgatatgtttttagcaatggagaaggctagctgtgctcccaactccagtctgctaaatcaagtggtcagggcgttgctggaaaaaggtgcagttgtaaaggctgcaacttatctcgctaaacttgatgctaaacagctgtcagttgaagcttcaacgatttcgttaatagtatctctcttctcaggggaagggaaactaagggagcacgtagagttgcttccagtaaagtaccagcctcctgagagttcggctgacaat

SEQ ID NO: 1949 - DNA, 2313 bp, Triticum aestivum; identical to SEQ ID NO: 1942

SEQ ID NO: 1950 - DNA, 2262 bp, Triticum aestivum
atgcctcgcttctcctccaccccgccaatgtcgccacgccgcctccgcgtcggactcggcgcccgccactcctcctccacctcccatccctcacgcagctgggagccccacgccgccttcgccgccgccacggagcgtgcgcgatctggcaacctcaccccggaggacgcacaccaccggttcgacgaattgctccggcaggccaatcctgtccaggagcgccccttgaacaaacgtctctccgccctcgccggtgctccggcgtccgcggcctgcagaaacggccctgcactcgcggtcgccctcttcagccgcatatcccaaggtgcccgccgacgtgtggcgcacccaacggcctgcacctacggcatcctcatggactgctgctgccgcgcacaccgcctcgatctggcgttcgctttcttcggccgtctcctcaggacgggacttaaggcaggcgtcattcaagtttgcactcttctcaagggcctctgccgcgcaaagcgggctgatgaggctctcgacgtgctgcttcacaggatgcctgagctggggggctgcacccccaacgtggtggcgtataccacggtcatccacagcttctttaaggaaggccaagtaagcaaggcatgcaatctattccatgaaatggcgctgcagggcgttacacctgatgtggtgacatatagctcggttattgatgcgctgtgcaaggccagagccatggacaaggcagagtatttccttcgtcagatggttcataatggtgtcctacctaataatgtgacatataatagcctcatccatggatattcctcttcaggccattggaaggaggcggttagggtgctgaaagaaatgacaagtcaaggtatcatacctgatatcatttcataccgtattctgcttcatgggtatgccaccgaagggtgcttagttgatatgattaatctcttcaattcaatggcaagatactgtattctacctgattgtcatatcttcaacatactgattaatgcatatgctaaatctgggaagcttgataaggctatgcttatatttaaagaaatgcagaaacaaggagtgagtccagatgcagtcacatattcaaccgtaatacatgcattttgcaaaaatggcaggttggacgatgctgtgataaagtttaatcaaatgattgatacaggagtacaaccgaacacatctgtttataatgccctaatccaggggttttctacaaatggcgatttggtgaaggcaaaggaattggttacggaaatgatgaacaaaggtatgcatcctcctgatattaaggtcttccattcggtaatgcagaacctatgcacagaaggaagggtaacagaagcacgggatatccttgacttgatagtgcacataggtatgaggcctgatgttttcacatttacttcactgagcggtggatactgcctagtccgcaacatggaggatgcatcaaaaatatttgatgatatggtgtcatatggtttagaaccttctaacatcacgtatggtatacttattaatggctattgcaaaaacaaaaggattgatgaggggctgattctgttcaaagaaatgttgcgcaagggacttaaacctacaactattaattacaatgtcatattggatggattatttctggctggacgaactgttgctgcaaaggaaaagtttaatgagatggttgaatctggagtaagtgtgtgcattgatacatattcgatagttcttggtggactttgcacaaataactgttgcggcgaagccatcacgctattccagaaattaagcaaaatgaatgtgaaattcaatattagaattgtcaatatcatgattgatgccttcttcaaggttcagcgaaagcaagaagctgaggatttgtttgctgcaatatcagcaaatgggttggttgctaatgtttttacctacagcctaatgatgacaaatcttataaaagaagggtcagcggaagaagctgacactctctttttatcgatggagaagagcggctgtactgccaactcgtggatgttaaatcttattatcagaaggctactggaaaaaggagagatagtgaaggctggaaattatatggctaaagtcgatgcaaagagctactcacttgaagctaaaactgtttcgctgctgatttctctcttttcagggaaagggaaatacagagaacacataagattgctgcctacaaagtatcagtttcgtgaagaagcagccatagttgaa

SEQ ID NO: 1951 - DNA, 2370 bp, Triticum aestivum
atgatctcccactcgtcgtcttcccagagttcacgacctactcactgtaaaaaacaatgctactgtacccgtcgtctcccactcgtcttgctcccacttcacaccaaggccatgcctcgcctctcctccaccacgcccatgtcgccactccgcctccgcctccgcctccgcgcccgccactccgcctccacctcccattcctcacgcagctgggagccccacgccgccttcgccgccgccacggagcgtgcgcgctctggcaaactcaccccggaggacgcacaccacctgttcgacgaattgctgcggcaggccaaacctgtccaggagcgcccccttaacaaccttcttgccgccctagctcgtgctccggcgtccgcggcgtgcagcgatggccctgcactcgcagtcaacctcttcggccgcatatcccaaggcgcctgccgacgtgtggcgcacccaacggcctgcacctacggcatcctcatggactgctgctgccgtgcacaccgcctcgatctggcgttcgctttcttcggccgtctcctcaggacgggacttaaggcaggcgtcattcaagtttgcactcttctcaagggcctctgccgcgcaaagcgggctgatgaggctctggacatgctgcttcacaggatgcctgagctgggctgcacccccaacgtggtggcatataccacggtcatccacggcttctttaaggaaggccaagtaagcaaggcatgcaatctattccatgaaatggcgctgcagggcgttacacctgatgtggtgacatatagctcggttattgatgcactgtgcaaggccagagccatggacaaggcagagtatttccttcgtcagatggttcataatggtgtcctacctaataatgtgacatataatagcctcatccatggatattcctcttcaggccattggaaggaggccgttagggtgctgaaagaaatgacaagtcaaggtatcatacctgatatcgtttcataccgtattctgcttcatgggtatgccaccgaagggtgcttagttgatatgattaatctcttcaattcaatggcaagatactgtattctacctgattgtcatatcttcaacatactgattaatgcatatgctaaatctgggaagcttgataaggctatgcttatatttaaagaaatgcagaaacaaggagtgagtccagatgcagtcacatattcaaccgtaatacatgcattttgcaaaaagggtaggttggatgatgctgtgataaagtttaatcaaatgattgatacaggagtacaaccgaaaacatctgtttataatgccctaatccaggggttttctacaaatggcgatttggtgaaggcaaaggaattggttatggaaatgatgaacaaaggtatgcatcctcctgatattaaggtcttccattcggtaatgcagaacctatgcacagaaggaagggtaacagaagcacgggatatccttgacttgatagtgcacataggtatgaggcctgatgttttcacatttactttactgatcggtggatactgcctagtccgcaacatggaggatgcatcaaaaatatttgatgatatggtgtcatatggtttagaaccttctaacatcacgtatggtatacttattaatggctattgcaaaaacaaaaggattgatgaggggctgattctgttcaaagaaatgttgcgcaagggacttaaacctacaactattaattacaatgtcatattggatggattatttctggctggacgaactgttgctgcaaaggaaaagtttaatgagatggttgaatctggagtaagcgtgtgcattgatacatattcgatagttcttggtggactttgcacaaataactgttgcggcgaagccatcacgctattccagaaattaagcaaaatgaatgtgaaattcaatattagaattgtcaatatcatgattgatgccttcttcaaggttcagcgaaagcaagaagctgaggatttgtttgctgcaatatcagcaaatgggttggttgctaatgtttttacctacagcctaatgatgacaaatcttataaaagaagggtcagcggaagaagctgacactctctttttatcgatggagaagagcggctgtactgccaactcgtggatgttaaatcttattatcagaaggctactgaaaaaaggagagatagtgaaggctggaaattatatggctaaagtcgatgcaaagagctactcacttgaagctaaaactgtttcgctgctgatttctctcttttcagggaaagggaaatacagagaacacataagattgctgcctacaaagtatcagtttcgtgaagaagcagccatagttgaa

SEQ ID NO: 1952 - DNA, 1290 bp, Triticum aestivum
atgaaaagcaacggtattgcagccgactgccgtgttttcaccatattaattgatgcatatgctaaacgcggaatgatggatgatgcaatgcacatatttgcggaaatgcgggaaaaaggagtgagtcccaatgtagtcacctatgccactgtaataggcgcactttgcagattgggtaggctggccgatgctatggacaggttcaatgagatgactgatatgggtgtacagccgaacacagctgtttatcactccctaattcagggtttttgtatgcatggtgatttgggtaaagccaaggagttagtttctgacatgataagcaaaggtattcctcgtcccaacattgtgttcttcaattcagttataaactatttgtgcaaagaaggaaggattatggatgcacaagatatctttgaattggttataatcatagatgggaagcctgatgtcattacatttaactcactgattgacggacattgcttagtcagcaagatggataaagcatttggagtacttggtgccatgttgtcagctggcattgagcctaatgttgttacatataatacacttgttaatggctattctagaaatggaaggatcgatgatggtttgactctgttcagacaaatgccacgtaagagaataaaacctgacagtgccacatatgggatcatactggatgggttgtttcgtgctgggagaactgttgctgcaaggaaaatgttccatgatatgatcgaaagcggaataacagtgagcatttccacatacaatattatacttgcaggtctttctagaaacaattgtgcagaagaagcgatcgacctgtaccagaaattagttgcaatgaatgtgaagttcaatatttcaataatcaataccatgatcaatgcaatgtacaaggttaaaagaaaagaggaagctaaagatttgtttgctgctatatcagcgagtgggttggttcctaatgcttcgacttatggagtaatgataataaatattctaaaagatggagcagtggaagatgctaacaatatgttctcagcaatggacaggaatggtatagctccctgctctcgtcttatagatagtattatcagaattttgctggaaaaaggtgagatcaccatggccggactttatttgttgaaacttgacgggaagaacatgctacttgaagcttcaactacttcactgatgttgtctctcttttcaaggaaagggaaatataaggaggatgtgaaatttctccctgcaaagtatcagttttttgatggatttggt

SEQ ID NO: 1953 - DNA, 1290 bp, Triticum aestivum; identical to SEQ ID NO: 1952

SEQ ID NO: 1954 - DNA, 2340 bp, Triticum aestivum
atgtcccgcctccgcctccgccgctcctccaccacgccgatgttccacatcctccgccgcagctcctcctctacctccatctcgcccccctcacgttcctggtctcccgaaggcgcctttgccgcggccacggcgcgtctcagcactggaacgctcagccctgaagaagcacaccacctgttcgacgaattgctgcggcaggccaccccggtccccagccgctccctgaacggcttccttgccacccttgcccgtgcgcctgcctccgcggcctgcagcagagatggccctgccctcgccctcgccctcgctctcttcaaccgcgtgtgcgcagaagaagccgacccgcgggtggcgcctctcacagtccacacctacggcatcctcatggactgctgctgccgcgcgcgtcgcccggacctggggcttgccttattcgcacgcttcctcaggacaggcctcaagacaaatgagatcatcgctaacaccttcctcaagtgcctctgctatgccaaacgtacagatgaggctatcaacttgctgcttcataggatgcccgagcttggctgcgtgcctgatgcaatctcatacaccattgttctgaagagcttatgcgagaatagcatgagtcagcgggcactcgacctgctccagatggtggcagaaggaggaggtgcctgctccctcaatgtggtggcgtatagcacagtcatccatggcttcttcaaggagggcgaaacaggcaaggcatgcaatctattccatgaaatgacccgtcaaggggttgtgcccaatgtggtcacgtatagctcgattattgatgcgttgtgcaagtccagagcaatggacaaggcagagctagtccttcaacagatggttgatagtggtgctcaaccgaataatgtgacatataattgcatgatccatggatattccacatcagggcagttgaaagaggctgctaaaatgtttagaaaaatgacaagccatggtcttgtaccaaatgcagtcacttgcagctcgttaatgacttccctttgcaagcatggaagaagcaaagaagcggcggaaatattttattccatgactgccaagggccacaaaccggatgccgtctcgtaccgtattttgcttcatgggtatgccaatgaaggatgctttgctgatatgattgatctctttaattcaatgaaaagcaacggtattgcagccgactgccgtgttttcaccatattaattgatgcatatgctaaacgcggaatgatggatgatgcaatgcacatatttgcggaaatgcgggaaaaaggagtgagtcccaatgtagtcacctatgccactgtaatagccgcactttgcagattgggtaggctggccgatgctatggacaggttcaatgagatgactgatatgggtgtacagccgaacacagctgtttatcactccctaattcagggtttttgtatgcatggtgatttgggtaaagccaaggagttagtttctgacatgataagcaaaggtattcctcgtcccaacattgtgttcttcaattcagttataaactatttgtgcaaagaaggaaggattatggatgcacaagatatctttgaattggttataatcatagatgggaagcctgatgtcattacatttaactcactgattgacggacattgcttagtcggcaagatggataaagcatttggagtacttgatgccatgttgtcagctggcattgagcctaatgttgttacatataatacacttgttaatggctattctagaaatggaaggatcgatgatggtttgactctgttcagacaaatgccacgtaagagaataaaacctgacagtgccacatatgggatcatactggatgggttgtttcgtgctgggagaactgttgctgcaaggaaaatgttccatgatatgatcgaaagcggaataacagtgagcatttccacatacaatattatacttgcaggtctttctagaaacaattgtgcagaagaagcgatcgacctgtaccagaaattagttgcaatgaatgtgaagttcaatatttcaataatcaataccatgatcaatgcaatgtacaaggttaaaagaaaagaggaagctaaagatttgtttgctgctatatcagcgagtgggttggttcctaatgcttcgacttatggagtaatgataataaatattctaaaagatggagcagtggaagatgctaacaatatgttctcagcaatggacaggaatggtatagctccctgctctcgtcttataaatagtattatcagaattttgctcaaaaaggtgagatcaccatggccggactttatttgt

SEQ ID NO: 1955 - DNA, 2340 bp, Triticum aestivum; identical to SEQ ID NO: 1954

SEQ ID NO: 1956 - DNA, 2340 bp, Triticum aestivum; identical to SEQ ID NO: 1954

SEQ ID NO: 1957 - DNA, 1290 bp, Triticum aestivum
atgaaaagcaacggtattgcagccgactgccgtgttttcaccatattaattgatgcatatgctaaacgcggaatgatggatgatgcaatgcacatatttgcggaaatgcgggaaaaaggagtgagtcccaatgtagtcacctatgccactgtaataggcgcactttgcagattgggtaggctggccgatgctatggacaggttcaatgagatgactgatatgggtgtacagccgaacacagctgtttatcactccctaattcagggtttttgtatgcatggtgatttgggtaaagccaaggagttagtttctgacatgataagcaaaggtattcctcgtcccaacattgtgttcttcaattcagttataaactatttgtgcaaagaaggaaggattatggatgcacaagatatctttgaattggttataatcatagatgggaagcctgatgtcattacatttaactcactgattgacggacattgcttagtcagcaagatggataaagcatttggagtacttggtgccatgttgtcagctggcattgagcctaatgttgttacatataatacacttgttaatggctattgtagaaatggaaggatcgatgatggtttgactctgttcagacaaatgccacgtaagagaataaaacctgacagtgccacatatgggatcatactggatgggttgtttcgtgctgggagaactgttgctgcaaggaaaatgttccatgatatgatcgaaagcggaataacagtgagcatttccacatacaatattatacttgcaggtctttctagaaacaattgtgcagaagaagcgatcgacctgtaccagaaattagttgcaatgaatgtgaagttcaatatttcaataatcaataccatgatcaatgcaatgtacaaggttaaaagaaaagaggaagctaaagatttgtttgctgctatatcagcgagtgggttggttcctaatgcttcgacttatggagtaatgataataaatattctaaaagatggagcagtggaagatgctaacaatatgttctcagcaatggacaggaatggtatagctccctgctctcgtcttatagatagtattatcagaattttgctggaaaaaggtgagatcaccatggccggactttatttgttgaaacttgacgggaagaacatgctacttgaagcttcaactacttcactgatgttgtctctcttttcaaggaaagggaaatataaggaggatgtgaaatttctccctgcaaagtatcagttttttgatggatttggt

SEQ ID NO: 1958 - DNA, 2340 bp, Triticum aestivum
atgcagaccggccgcctgtcctccatcttcaccagcaacgcaacctcctccttcagggctccttcgccacaaccacgacccccccttgccgccttggctgccgccacagagcgtgcgcgcgccggaacgctaagaccggaggaggctcaccacctgttcgacgaattgctgagccaagccgcccctgtcccagaacgcgggctgaacaacttttttgctgcactcgcccgtgctccgccctcagctgcgtgcggcgatggccctgcccttgccatcgctctcttcaaccgcatgtcccgaggcgtgggtccatggatggcatcgcccgctggctgtacctattccatcctcatggactgttgctgccgcgcaggacgcccggacttggtggttgccttcttcggccgcctcctcaggttgggcctgcgcttggaggtcatctccttcaacaacctcctcaaggggctctgccatgcccagcgtacaaatgaggctttggacgtgctgctccaccgcacacccgaactagactgtgtgcctgacgtcttctcctacagcatagtaatcaacagctgctttaaagaaggtgaagtagacaaagcgtgcaatctcttccatgagatgatccaactgggagttcaacctgatgtggccatctacacctcaattatcgacgcactaagcaaggctggagccatggacaaggcagaagtggtccttcagcagatggttgatcaaggaattgaacccgatgtcatgacatatactagcctgatacatggatattccggttcgggtcagtggaaggcggcagttagagtattcaaggaaatggcaagtgctggtgttctaccaaatgccttcactttgaactcatttatggattcactttgcaagcatagaaggacaaaggaagctagagttatttttgactcaatggctgcaaagggccaaaaactaaatatcgtctcctactctattatgcttaacgggtatgcgaaagaaggatgctttgatgatatgactggtctcttgaatttgatgctacagaatggtgttgtacctaaccaccatattttcaacatactgatcaatgcatatgctaaacgtggactgatggatgaggctatgcacatgttcgaagtaatgaggcaacaaggagtaaacccggatgtagttgactatctagtaataatggattcactttgtaaaatgggtaggatggatgctgctctggacaaatttaatcagatggtcaatcaaggagtttcacctaacaaagctatttaccaatgcctggttctgggttcttgctctcatggtcattttgtgaaagccaaggaattgatttctgaagcaattaatagaggtctgttttctaacagtgtgttcttctatcctgtaataaacgacctgtgcaaagaaggaaaggtgaaggaggcacaggatatgtttgacttcattctaggtattggtcagcggcctgatgtgattatgtacaattcactgatggatggatattgccttgttggcaaggtggaggaagcagtgagagtacttgatgctatgaagtctgctggcctccaacctactgccgttacgtatgctatacttcttaatggctactgtaaaattggcaggatcgccgatggattgagtcttttcagggaaatgtcactcagcggggttaagcccacgactattatgtacaacattatacttgatgggctgtttcgctccgggagaacagtttctgcaaaggaaaaattccgtacgatgagcgaaagtggcataccagtgggcattggcacatacaacataattcttcatggattttgtagaagcaattgcactgatgaagcaatagagttgttcaagaaattatgtgcaatgaacgtgaagattgatgtcataacactcaataccatgatttctgtaatgtttaaaactaggagaattgaagaagccaaggatttgtttgctactatatcagccatcggattggtgccttctgttgtgacttacagtgtaatgatgacgaatttcataaaagaagggttgctggcagaggctgatgatatgtttttagcaatggagaaggctggctgtgctcctgactgcaggctgctaaatcatgtagtcagggtgttgctggaaaaaggtgcagttgtaaaggctgcaacttatctcgctaaacttgatgcgaaagagctgtcacttgaagcttcaacggtttcgttaatagtatctctcttctcaaggagaggcaaattaagggagcacgtaaaattgcttccagtaaagtaccagcctcctgagatattacttggaacttcctac

SEQ ID NO: 1959 - DNA, 2283 bp, Triticum aestivum
atgcctcgcttctcttccaccacgtcaatgtcgtcactccgcctccgcctccgcctccgcctgcacgcctgccactcctcctcggcctcgcaaccctcacgcagccagggatgggatccccacgccgccttcgccgtcgccacggagtgtgcgcgctccggcaacctcaccccggagggcgcacataacctgttcgacgaattgctgcggcagggcaatcctgtcctggggcgccccctcaacaaccttctcgccgccctcgcccgtgcgccggcgtccagctcctgcagagatggccctgcactcgcggtcgccctcttcagccgcatatcccaaggcgcccgcctaagggtggtgcacccaacggcctgcacctacagcatcctcatggactgctgctgccgcgcgcgccacctggatctggcactcgccttcttcggccgtctcctcaggactgggctgaaggcaggcgccatagaagtcaacattcttctcaagagcctctgccatgcaaagcgggcagatgaggccatggaagtgcttcttcacaggatgcctgagctgggttgcacccctgactcggtggcgtataacacggtcatccacgggttctttaaggaaggccaagtaggcagagcaatggacaaggcggagtatttccttcgtgaaatggttgataatggtgtcatacctaataatgtgacatataatagcctcatccatggatattcctcttcaggctatcagaaggaggcggttagggtgctgaaagaaatgacaagtcagggtatcataccagatgtttttacttgcaactcgctcatggcctccctttccaagaatggaagaagcaaagaagctgcagaaatttatgactccatggccatgaagggcctggaacctgatatcgtctcgtataatactcggcttcacgggtatgccaccgaaggatgcttagttgatatgactaatctctttaattcaatgactagagatggtattcggcctaactgtcacactttgaacatattgattaatgcatatgctaaatttggcatgatggatgaggctatgcttatatttaaaggaatgcggaaacagggagtgagtccagatgtagtcacctattcaaccgtaatacatgcattttgcaaaatgggtagcttggacattgctatggacaaatttaagcagatgactgatatgggagtacgaccgaatccaattgtttatcattccctaatccagggtttttgtacacatggggatttagtgaaagcaaaggagttggttactgaaatgaggaacaaaggtatgcgtcctcctgatattaaggtcttccatttggtgatgcagaacctatgcacggaaggaagggtaacaaaagcacgggatatccttgacttgatagtgcgcattggtatgaggcctgatgttttcatatttaatatactgatcggtggatactgcctagtccgcaagatggcagatgcatcaaaaatatttgatgatatggtgtcatatggtttagaaccttctaatattacatatggtatacttattaatggctattgcaaaaacaaaaggattgatgatgggctgattctattcaaaacaatgttgcacaagggacttaaacctacaacttttaattataacgtcatactggatggattatttctggctggacgaacagttgctgcaaaagagaagtttaatgagatggttgaatctggagtaagtgtgtgcattgatacatgctctatagttcttggtggactttgtaaaaataactgcagcagcgaagcgatcaccctgttacggaaattaagcacaatgaatgtgaaatttgatattacaattgtcaatatcattattggtgcattctacagggtcaagagaaaccaagaggctaaggatttgtttgctgctataccagccaatggcttggttcctaatgctgttacctacaccataatgatgacaaatcttataaaagaaggttcagtggaagaagccgacaatctttttttatcaatggagaagagcggctctactgcaaactcttggatgttaaatcatattatcagaaggttactggaaagaggagagatagtcaaggctggaaattatatgtctaaagttgatgtaaagagctactcacttgaagctaaaactgtttcactgctgatctctctgttttcaagggaagggaaatatagagaccacatcaaattgctccctacaaagtatcagtttctggaagaagcagccacagttgaa

SEQ ID NO: 1960 - DNA, 1089 bp, Triticum aestivum
atggttgatatgggagtacgaccgaatgcaattgtttatcattccctaatccggggtttttgtacacatggggatttagtgaaagcaaaggaattggttactgaaatgaggaacaaagctatgcgtcctcctcatattaagttcttccattcaataatgcagaacctatgcacggaaggaagggtaatagaagcacgggatatcctcgacttgatgctgcacataggtatgaggcctgatgttcccatctttaatttactaatcggtggatattgcctagtccgcgagatggaggatgcaacaaaaatgtttgatgatatggtgtcatatggtttagaaccttgtaacaatacgtatggtatacttattaatggctattgcaaaaatagaaggattgatgacgggcttattctattcaaagagatgctgcgcaagggacttaaacctacaacttttaattataacgtcatactggatggattatttctggctggacgaactgttgctgcaaaggtgaagtttaatgagatggttgaatctggagtaagtgtgtgcattgatacatactctatagttcttggtggactttgtagaaataattgcaccggtgaagcaatcacgctgtccaagaaattaagtacaatgaatgtcaaattcaatattgcaattgtcaatatcttgattggtgcattcttcagggttcggcgaaaccaagaagctaaggatttgtttgctgctataccagccaatggcttggttcctaatgctgttacctacaccataatgatgacaaatcttataaaagaaggttcagtggaagaagctgacactctctttttatcaatggagaagagcgggtgtactgccaactcttgtatgttaaatcatattatcagaaggttactggaaagaggagagatagtcaaggctggaaattatatgtcgaaagttgatgcaaagagctactcacttgaagctaaaactgtttcgctgctgatctccctcttgtcagggaaagggaaatatagagaacacataaaattgctccctatgaagtatcagtttctcgaagaagcagccacagttgaa

SEQ ID NO: 1961 - DNA, 2277 bp, Triticum aestivum
atgaatatccggactactagactacactacatccccactcgtcttgctccagagttcacggcctactcaccaaggcccatgcctggcttctcctatgccgcgtcaatgtcgccactccgcctccgcctgcacgcccgccactccgcctccgcctcgcaaccctcacgcagccagggatgggatccccacgccgccttggccgtcgccacggttgccctcttcagccgcatatcccaaggcgccctccgacgtgtggcacatccaacggcttgcacctacagcatcctcatggactgctgctgccgcgcacaccgccctgatatggcactcgccttcttcggtcgtctcctcaggacgggtctggaggcagaccaagtcgttttcagcaccctcctcaagggactctgccacgcaaagcgctcagatgaggctctggacgtgctgctgcacaggatgcctgagctcggctgcaccacccacgtggtggcgtataacaccgtcatccatggcttctttagggaaggccaagtaggcaaggcgtgcgatatcttccatggaatggcgcagcagggcgttgcgcctaatgtggtgacatataactcggttattgatgcgctgtgcaaggccagagcaatggacaaggcagagtatttccttggtcagatggttgatagtggtgtcgtacctaataatgtcacatataatagcctcatccatggatattcctcttcaggccattcaaaggaggcggtcagggtgctgaaacagatgacaagtaagggtatcataccagatgtttttacttgcaacttgctcatggcctccctttgcaacaacagaagaagcaaagaagctgcagaactttttgactccatggccatgaagggcctgaaacctaacaccgtttcatatgctattctccttcataggtatgccactgaaggatgcctagttgacatgatcaatctcttcaactcaatggcaacagactgtattctacctaactgtcgtatcttcaacatactgattaatgcatatgctaaatctgggaagcttgataaggctatgcttatatttaaagaaatgcacaagcgaggagtgagtccagatgtagtcacctattcaactgtaatacatgcattttgcaaaatgggtagcttggacattgctatggacaaatttaaccagatggttgatatgggagtacgaccgaatgcaactgtttatcattccctaatccagggtttttgtacacatggggatttagtgaaagcaaaggaattggttactgaaatgaggaacaaagctatgcgtcctcctgatattaagttcttccattcaataatgcagaacctatgcacggaaggaagggtaattgaagcacgggatatcctcgacttgatgctgcacataggtatgaggcctgatgttcccatctttaatttactaatcggtggatactgcctagtccgcgagatggaggatgcaacaaaaatgtttgatgatatggtgtcatatggtttagaaccttgtaacaatacgtatggtatacttattaatggctattgcaaaaatagaaggattgatgacgggcttattctattcaaagagatgctgcgcaagggacttaaacctacaacttttaattataacgtcatactggatggattatttctggctggacgaactgttgctgcaaaggtgaagtttaatgagatggttgaatctggagtaagtgtgtgcattgatacatactctatagttcttggtggactttgtagaaataattgcaccggtgaagcaatcacgctgtccaagaaattaagtacaatgaatgtcaaattcaatattgcaattgtcaatatcttgattggtgcattcttcagggttcggcgaaaccaagaagctaaggatttgtttgctgctataccagccaatggcttggttcctaatgctgttacctacaccataatgatgacaaatcttataaaagaaggttcagtggaagaagctgacaatctttttttatcgatggagaagagcggctgtagtgccaactcttatatgttaaatcatatcatcagaaggttactggaaaaaggagagatggtcaaggctggaaattatatgtctaaagttgatgcaaagagctactcccttgaagctaaaactgtttcactgctgatctctctgttttcaaggaaagggaaatatagagaacacatcaaattgctccctacaaagtatcagtttctggaagaagcagccacagttgaa

SEQ ID NO: 1962 - DNA, 1089 bp, Triticum aestivum; identical to SEQ ID NO: 1960

SEQ ID NO: 1963 - DNA, 2277 bp, Triticum aestivum
atgaatatccggactactagactacactacatccccactcgtcttgctccagagttcacggcctactcaccaaggcccatgcctggcttctcctatgccgcgtcaatgtcgccactccgcctccgcctgcacgcccgccactccgcctccgcctcgcaaccctcacgcagccagggatgggatccccacgccgccttggccgtcgccacggttgccctcttcagccgcatatcccaaggcgccctccgacgtgtggcacatccaacggcttgcacctacagcatcctcatggactgctgctgccgcgcacaccgccctgatatggcactcgccttcttcggtcgtctcctcaggacgggtctggaggcagaccaagtcgttttcagcaccctcctcaagggactctgccacgcaaagcgctcagatgaggctctggacgtgctgctgcacaggatgcctgagctcggctgcaccacccacgtggtggcgtataacaccgtcatccatggcttctttagggaaggccaagtaggcaaggcgtgcgatatcttccatggaatggcgcagcagggcgttgcgcctaatgtggtgacatataactcggttattgatgcgctgtgcaaggccagagcaatggacaaggcagagtatttccttggtcagatggttgatagtggtgtcgtacctaataatgtcacatataatagcctcatccatggatattcctcttcaggccattcaaaggaggcggtcagggtgctgaaacagatgacaagtaagggtatcataccagatgtttttacttgcaacttgctcatggcctccctttgcaacaacagaagaagcaaagaagctgcagaactttttgactccatggccatgaagggcctgaaacctaacaccgtttcatatgctattctccttcatgggtatgccactgaaggatgcctagttgacatgatcaatctcttcaactcaatggcaacagactgtattctacctaactgtcgtatcttcaacatactgattaatgcatatgctaaatctgggaagcttgataaggctatgcttatatttaaagaaatgcacaagcgaggagtgagtccagatgtagtcacctattcaactgtaatacatgcattttgcaaaatgggtagcttggacattgctatggacaaatttaaccagatggttgatatgggagtacgaccgaatgcaactgtttatcattccctaatccagggtttttgtacacatggggatttagtgaaagcaaaggaattggttactgaaatgaggaacaaagctatgcgtcctcctgatattaagttcttccattcaataatgcagaacctatgcacggaaggaagggtaattgaagcacgggatatcctcgacttgatgctgcacataggtatgaggcctgatgttcccatctttaatttactaatcggtggatactgcctagtccgcgagatggaggatgcaacaaaaatgtttgatgatatggtgtcatatggtttagaaccttgtaacaatacgtatggtatacttattaatggctattgcaaaaatagaaggattgatgacgggcttattctattcaaagagatgctgcgcaagggacttaaacctacaacttttaattataacgtcatactggatggattatttctggctggacgaactgttgctgcaaaggtgaagtttaatgagatggttgaatctggagtaagtgtgtgcattgatacatactctatagttcttggtggactttgtagaaataattgcaccggtgaagcaatcacgctgtccaagaaattaagtacaatgaatgtcaaattcaatattgcaattgtcaatatcttgattggtgcattcttcagggttcggcgaaaccaagaagctaaggatttgtttgctgctataccagccaatggcttggttcctaatgctgttacctacaccataatgatgacaaatcttataaaagaaggttcagtggaagaagctgacaatctttttttatcgatggagaagagcggctgtagtgccaactcttatatgttaaatcatatcatcagaaggttactggaaaaaggagagatggtcaaggctggaaattatatgtctaaagttgatgcaaagagctactcccttgaagctaaaactgtttcactgctgatctctctgttttcaaggaaagggaaatatagagaacacatcaaattgctccctacaaagtatcagtttctggaagaagcagccacagttgaa

SEQ ID NO: 1964 - DNA, 1707 bp, Triticum aestivum
atgatcaacctgggagttcaacctgatgcggtgacctacagctcatttatcaacgcactaagcaagtccggagtaatggacaaggcagaagtggtccttcgacaaatggttgatcaaggcattgtacccaatatcattacgtatactagtctgatccatggatattccacttcgggtcagtggaaagcagcagttaggatattcaaagaaatgacaagtaccggtgttcgaccaaattctgtcacgttgaactcatttattgattccctttgcaagcatagaaagacaaaggaagctagagatatttttgactccatggccgcaaacggccacaaacctgatattttctcctactctactttgcttaatgggtatgtgaaagaaggatgcttcgatgatatgactgatctcttcaattcgatggtatggaatggtattgtacctaaccaccatgttttcaacatactgatcaatgcatatgctaaacgtggactgatggataaggctatgcacatgttcgaagtaatgaggcaacaaggagtaaacccagatgtatttagctatcaaattgtaatggattcactttgcaaaatgggcaggatggatgccgctctggacaaatttaatcagatggtcaatcaaggagtttcacctaacaaagctgtttaccaatgcctggttctgggttcttgctctcatggtcattttgtgaaagccaaggaattgatctctgaagcaattaatagaggtctgtattctaacagtgtgttcttctatcgtgtaataaacgacctttgcaaagaaggaaaggtaaacgaggcacaggatatgtttgacttcatcctaggtattggtcagcgacctgatgtgattatgtacacttcactgatggatggatattgccttgttggcgaggtggagaaagcactgagtgtactcgatgctatgaaatctgctggccttcaacctgatgatgttgtatatggtacacttcttaacggttactgtaaaattggaaggattgccgatggattgagccttttcagggaaatgtcactcagcgtggttaagcccacgactattatatacaacattatactggatgggctgttttgctctgggagaacagtttgtgcaaaggaaaaatttgatatgatgattgaaagtggcataccagtgggcgttgacacatacaatatagttcttcatggactttgtagaaacaattgcactgatgaagcaatagagctgttcaagaaattacgtgctatgaacgtgaagattaatgtcataacactcaataccatgatttctgcattgtttaaaactaggagaattgaagaagccaaggatttgtttgctactatatcagccattgggttggtgccttctgttgtgacttacagtgtaatgatgacaaatttcataaaagaagggttgctggcagatgctgatgatatgttttcagcaatggagaaggctggctgtgctcccaactccagactgctaaatcaagtggtcagggtatttctgaagaatggtgaagttgtaaaggctgtgacttatcttgctaaacttgatgcaaaacagctgtcacttgaagcttcgacggtttcgttaatagtatctctcttctcaaggaaagggaaattaaggaagcatgtaaaattgcttccggtaaagtaccagcctcctgagatgttggac

SEQ ID NO: 1965 - DNA, 2316 bp, Triticum aestivum
atgccaaccgcccgcctgtgctccatctccgcctcctccttcaaggcttcttcaggaaaaccacgagctcctgtcgccgccttggctgctgccactgagcgtgtgcgcgctggaacactaaaccaggaggacgcgcaccacctgtttgacgaattgctaagccaagccgccgccttcccagtaggcgggctgaataactttcttgccacactcgcccgtgcacggccctcagctgcctgcagcaatggccctgcccttgctgtcgccctcttcaaccgcatgtcccgaggccctggtgcacgggtggtgtcgcccacgtgctgtacctattccatcctcatggactgctgctgccgcgcaggccgcccggacttggtgcttgccttcttctgccgcctcctcaggttggggctgagcttgaatgtcacctccttcaacaacctactcaaggggctctgccagtcaaagcgtacaaatgaggctttggacgtgctgctccagcgtacgcccgaactagactgtgcgcctgatgtcgtctcgtacaacatagtaatcaacggctgtttgaaacaaggtgaagtggagaaagcgtgcaatctctaccgtgagatgatcaacctgggagttcaacctgatgcggtgacctacagctcatttatcaacacactaagcaagtccggagcaatggacaaggcagaagtggtccttcggcaaatggttgatcaaggcattgtacccaatatcattacgtatactagtctgatccatggatattccacttcgggtcagtggaaagcagcagttaggatattcaaagaaatgacaagtaccggtgttcgaccaaattctgtcacgttgaactcatttattgattccctttgcaagcatagaaagacaaaggaagctagagatatttttgactccatggccgcaaacggccacaaacctgatattttctcctactctactttgcttaacgggtatgtgaaagaaggatgcttcgatgatatgactgatctcttcaattcgatggtacagaatggtattgtacctaaccaccatgttttcaacatactgatcaatgcatatgctaaacgtggactgatggataaggctatgcacatgttcgaagtaatgaggcaacaaggagtaaacccagatgtatttagctatcaaattgtaatggattcactttgcaaaatgggcaggatggatgccgctctggacaaatttaatcagatggtcaatcaaggagtttcacctaacaaagctgtttaccaatgcctggttctgggttcttgctctcatggtcattttgtgaaagccaaggaattgatctctgaagcaattaatagaggtctgtattctaacagtgtgttcttctatcgtgtaataaacgacctttgcaaagaaggaaaggtaaacgaggcacaggatatgtttgacttcatcctaggtattggtcagcgacctgatgtgattatgtacacttcactgatggatggatattgccttgttggcgaggtggagaaagcactgagtgtactcgatgctatgaaatctgctggccttcaacctgatgatgttgtatatggtacacttcttaacggttactgtaaaattggaaggattgccgatggattgagccttttcagggaaatgtcactcagcgtggttaagcccgcgactattatatacaacattatactggatgggctgttttgctctgggagaacagtttgtgcaaaggaaaaatttgatatgatgattgaaagtggcataccagtgggcgttgacacatacaatatagttcttcatggactttgtagaaacaattgcactgatgaagcaatagagctgttcaagaaattacgtgctatgaacgtgaagattaatgtcataacactcaataccatgatttctgcattgtttaaaactaggagaattgaagaagccaaggatttgtttgctactatatcagccattgggttggtgccttctgttgtgacttacagtgtaatgatgacaaatttcataaaagaagggttgctggcagatgctgatgatatgttttcagcaatggagaaggctggctgtgctcccaactccagactgctaaatcaagtggtcagggtatttctgaagaatggtgaagttgtaaaggctgtgacttatcttgctaaacttgatgcaaaacagctgtcacttgaagcttcgacggtttcgttaatagtatctctcttctcaaggaaagggaaattaaggaagcatgtaaaattgcttccggtaaagtaccagcctcctgagatgttggac

SEQ ID NO: 1966 - DNA, 2316 bp, Triticum aestivum; identical to SEQ ID NO: 1965

SEQ ID NO: 1967 - DNA, 2316 bp, Triticum aestivum
atgccaaccgcccgcctgtgctccatctccgcctcctccttcaaggcttcttcaggaaaaccacgagctcctgtcgccgccttggctgctgccactgagcgtgtgcgcgctggaacactaaaccaggagggcgcgcaccacctgtttgacgaattgctaagccaagccgccgccttcccagtaggcgggctgaataactttcttgccacactcgcccgtgcacggccctcagctgcctgcagcaatggccctgcccttgctgtcgccctcttcaactgcatgtcccgaggccctggtgcacgggtggtgtcgcccacgtgctgtacctattccatcctcatggactgctgctgccgcgcaggccgcccggacttggtgcttgccttcttctgccgcctcctcaggttggggctgagcttgaatgtcacctccttcaacaacctactcaaggggctctgccagtcaaagcgtacaaatgaggctttggacgtgctgctccagcgtacgcccgaactagactgtgcgcctgatgtcgtctcgtacaacatagtaatcaacggctgtttgaaacaaggtgaagtggagaaagcgtgcaatctctaccgtgagatgatcaacctgggagttcaacctgatgcggtgacctacagctcatttatcaacgcactaagcaagtccggagcaatggacaaggcagaagtggtccttcggcaaatggttgatcaaggcattgtacccaatatcattacgtatactagtctgatccatggatattccacttcgggtgagtggaaagcagcagttaggatattcaaagaaatgacaagtgccggtgttcgaccaaattctgtcacgttgaactcatttattgattccctttgcaagcatataaagacaaaggaagctagagatatttttgactccatggccgcaaacggccacaaacctgatattttctcctactctactttgcttaacgggtatgtgaaagaaggatgcttcgatgatatgactgatctcttcaattcgatggtacggaatggtattgtacctaaccaccatgttttcaacatactgatcaatgcatatgctaaacgtggactgatggataaggctatgcacatgttcgaagtaatgaggcaacaaggagtaaacccagatgtatttagctatcaaattgtaatggattcactttgcaaaatgggcaggatggatgccgctctggacaaatttaatcagatggtcaatcaaggagtttcacctaacaaagctgtttaccaatgcctggttctgggttcttgctctcatggtcattttgtgaaagccaaggaattgatctctgaagcaattaatagaggtctgtattctaacagtgtgttcttctatcgtgtaataaacgacctttgcaaagaaggaaaggtaaacgaggcacaggatatgtttgacttcatcctaggtattggtcagcgacctgatgtgattatgtacacttcactgatggatggatattgccttgttggtgaggtggagaaagcactgagtgtactcgatgctatgaaatctgctggccttcaacctgatgatgttgtatatggtacacttcttaacggttactgtaaaattggaaggattgccgatggattgagccttttcagggaaatgtcactcagcgtggttaagcccacgactattatatacaacattatactggatgggctgttttgctctgggagaacagtttgtgcaaaggaaaaatttgatatgatgattgaaagtggcataccagtgggcgttgacacatacaatatagttcttcatggactttgtagaaacaattgcactgatgaagcaatagagctgttcaagaaattacgtgctatgaacgtgaagattaatgtcataacactcaataccatgatttctgcattgtttaaaactaggagaattgaagaagccaaggatttgtttgctactatatcagccattgggttggtgccttctgttgtgacttacagtgtaatgatgacaaatttcataaaagaagggttgctggcagatgctgatgatatgttttcagcaatggagaaggctggctgtgctcccaactccagactgctaaatcaagtggtcagggtatttctgaagaatggtgaagttgtaaaggctgtgacttatcttgctaaacttgatgcaaaacagctgtcacttgaagcttcgacggtttcgttaatagtatctctcttctcaaggaaagggaaattaaggaagcatgtaaaattgcttccggtaaagtaccagcctcctgagatgttggac

SEQ ID NO: 1968 - DNA, 2316 bp, Triticum aestivum; identical to SEQ ID NO: 1967

SEQ ID NO: 1969 - DNA, 2259 bp, Triticum aestivum
atgcctcgtttctcctccaccacgtcaatgtcgtcactccgcctccgcctccacgcccgccactcctcctccgcctctcaaccctcacacagccagggctgggatccccacgccgccttcgccgccgccacggagcgtgcccgctctggcaaactcaccccgaaggacgcacaccacctgttcgacgaattgctgcggcaggccaatcctgtccaggagcgccccctcaacaaccttctctccgcccttgcccgcgctccggcgtccgccgcctgcagaaacggccctgcactcgcggtcaacctcttcgtccgcatatcccaaggcgcccgccgacgtgtggcgcacccaacggcctgcacctacggcatcctcatggactgctgctgccgcgcacaccgcctcgatctggcgttcgctttcttcggccgtctcctcaggacgggacttaaggcaggcgtcattcaagtttgcactcttctcaagggcctctgccgcgcaaagcgggctgatgaggctctcgacgtgctgcttcacaggatgcctgagctgggctgcactcccgatgtggtggcatataccacggtcatccacggcttctttaaggaaggccaagtargcaaggcatgcaatctattccatgaaatggcgctgcagggcgttacacctgatgtggtgacatataactcggttattgatgcgctgtgcaaggccagagcaatggacaaagcagagtatttccttcgtcagatgattggtaatggtgtcgtacctaataatgtgacatataatagcctcatccatggatattcctcttcaggccattggaaggaggcggttagggtgctgaaagaaatgacaagtcaaggtatcatacctgatatcgtttcataccgtattctgcttcatgggtatgccaccgaagggtgcttagttgatatgattaatctcttcaattcaatggcaagatactgtattctacctgattgtcatatcttcaacatactgattaatgcatatgctaaatctgggaagcttgataaggctatgcttatatttaaagaaatgcagaaacaaggagtgagtccaaatgcagtcacatattcaactgtaatagatgcattttgcaaaaagggtcagttggacgatgctatgataaagtttaatcagatgattgatacaggagtaccacagggcacagctgtttatggttctctaatccagggtttttgtacacacggcaatttggtgaaagcaaaggaattgcttactgaaatgatgaacaaaggtatacctcctcctgatattaagttcttccattcaatcatgcagaacctttgcacagaaggaagggtaatagaagcacgggatgtccttggcttgatagcgcacataggtatgaggcctaatgtttgcacatttaatatactgatcggtggatattgcctagtcggcaagatggaggatgcctcaaaaatatttgatgatatgatgtcatatggcttagaaccttctaatattacgtatgctatacttattaatggctattgcaaaaacgaaaggattaacgatgggctgattctgttcaaagaaatgttgcgcaagggacttaaacctacaacttttaattacaacgtcatactggatggattatttctggctggacgaactgttgctgcaaaggaaaagtttgatgagatggttgaatttggagtaagtgtgcgcattgatacatattcgatagttcttggtggactttgtagaaataattgtaacggcgaagcaatcacgctattccagaaattaagcacaatggatgtgaaattcaatattacaattgtcaatataatgattgatgccttctacagggttcagcgaaaccaagaagccaaggatttgtttgctgcagtatcagccaatggtttggtagctaatgtctttacctacaccataatgatgaaaaatcttataaaagaagggtcagtggaagaagctgacgatctctttttatcaatggagaagagcggctgtactgctgactcttatatgttaaatcttatcgtcagaatgttactggaaaaaggagagctagtcaaggctgggaattatatgtctaaagttgatgcaaagagctactcacttgaagctgaaaccgtttcgctgcttatctctctcttttcagggaaagggaaatatagagaacacataggattgctccctacaaagtatcagtttcgtgaagaagcggccacagttgaa

SEQ ID NO: 1970 - DNA, 2259 bp, Triticum aestivum
atgcctcgtttctcctccaccacgtcaatgtcgtcactccgcctccgcctccacgcccgccactcctcctccgcctctcaaccctcacacagccagggctgggatccccacgccgccttcgccgccgccacggagcgtgcccgctctggcaaactcaccccgaaggacgcacaccacctgttcgacgaattgctgcggcaggccaatcctgtccaggagcgccccctcaacaaccttctctccgaccttgcccgcgctccggcgtccgcggcctgcagaaacggccctgcactcgcggtcaacctcttcgtccgcatatcccaaggcgcccgccgacgtgtggcgcacccaacggcctgcacctacggcatcctcatggactgctgctgccgcgcacaccgcctcgatctggcgttcgctttcttcggccgtctcctcaggacgggacttaaggcaggcgtcattcaagtttgcactcttctcaagggcctctgccgcgcaaagcgggctgatgaggctctcgacgtgctgcttcacaggatgcctgagctgggctgcactcccgatgtggtggcatataccacggtcatccacggcttctttaaggaaggccaagtaggcaaggcatgcaatctattccatgaaatggcgctgcagggcgttacacctgatgtggtgacatataactcggttattgatgcgctgtgcaaggccagagcaatggacaaagcagagtatttccttcgtcagatgattggtaatggtgtcgtacctaataatgtgacatataatagcctcatccatggatattcctcttcaggccattggaaggaggcggttagggtgctgaaagaaatgacaagtcaaggtatcatacctgatatcgtttcataccgtattctgcttcatgggtatgccaccgaagggtgcttagttgatatgattaatctcttcaattcaatggcaagatactgtattctacctgattgtcatatcttcaacatactgattaatgcatatgctaaatctgggaagcttgataaggctatgcttatatttaaagaaatgcagaaacaaggagtgagtccaaatgcagtcacatattcaactgtaatagatgcattttgcaaaaagggtcagttggacgatgctatgataaagtttaatcagatgattgatacaggagtaccacagggcacagctgtttatggttctctaatccagggtttttgtacacacggcaatttggtgaaagcaaaggaattgcttactgaaatgatgaacaaaggtatacctcctcctgatattaagttcttccattcaatcatgcagaacctttgcacagaaggaagggtaatagaagcacgggatgtccttggcttgatagcgcacataggtatgaggcctaatgtttgcacatttaatatactgatcggtggatattgcctagtcggcaagatggaggatgcctcaaaaatatttgatgatatgatgtcatatggcttagaaccttctaatattacgtatggtatacttattaatggctattgcaaaaacgaaaggattaacgatgggctgattctgttcaaagaaatgttgcgcaagggacttaaacctacaacttttaattacaacgtcatactggatggattatttctggctggacgaactgttgctgcaaaggaaaagtttaatgagatggttgaatttggagtaagtgtgcgcattgatacatattcgatagttcttggtggactttgtagaaataattgtagcgacgaagcaatcacgctattccagaaattaagcacaatggatgtgaaattcaatattacaattgtcaatataatgattgatgccttctacagggttcagcgaaaccaagaagccaaggatttgtttgctgcagtatcagccaatggtttggtagctgatgtctttacctacaccataatgatgaaaaatcttataaaagaagggtcagtggaagaagctgacgatctctttttatcaatggagaagagcggctgtactgctgactcttatatgttaaatcttatcgtcagaatgttactggaaaaaggagagctagtcaaggctgggaattatatgtctaaagttgatgcaaagagctactcacttgaagctgaaaccgtttcgctgcttatctctctcttttcagggaaagggaaatatagagaacacataggattgctccctacaaagtataagtttcgtgaagaagcggccacagttgaa

SEQ ID NO: 1971 - DNA, 990 bp, Triticum aestivum
atgccagccgcccgcctgtcctccatctccacctcctccttcagggctccttcacgagcccccctcgccgccttggctgccgccacggagcgtgtccgcgcgggaacgctgagccaggaggacgcgcaccacctgttcgaccaattgcttggccaagccgccgccgtcccggaacgcgggctcaacaactttcttgccgcactcgcccgtgctccaccctcagctgcctgccgcgatggccccggccttgccatcgccctcttcaaccgcatgtcccgaggcgctggtgcacgggtggcgtcgcccacgctctgtacctattccatcctcatggactgctgctgccgcgcaggccgcccggacttggtgcttgccttcttcggccgcctcctcaggttggggctgcgcttggatatcatctcctccagcaatctcctcaaggggctctgccaggccaagcgttcaaatgaggctttggacatgctgctccaccggatgcccgaactggactgtgtgcctgatgtcttctcgtacagcatagtaatcaacggctgttttaaacaaggtgaagtagacaaagcgtgcaatctcttccatcagatgccccaactgggagttcaacctaatgtggtgatctacaactcagttatcgacgcactaagcaaatccggagcaatggacaaggcagaagtggtccttcggcaaatggttgatcaaggaattgaacccaatatcaagacatataactgtctgatccatggatattctacttttggtcagtggaaggaggcacttagggtattcaaagaaatggcaagtcttggtgttgtaccagacgttgtcacgttgacctcattaatcgattccctttgcaagcacagaaggacaaaggaagctagagaaatttttgactctatggctgcaaagggcctgcctggttctgggttcttgctctcatggtcattttgtgaaagccaaggatttgatctc

SEQ ID NO: 1972 - DNA, 990 bp, Triticum aestivum; identical to SEQ ID NO: 1971

SEQ ID NO: 1973 - DNA, 990 bp, Triticum aestivum
atgccagccgcccgcctgtcctccatctccacctcctccttcagggctccttcacgagcccccctcgccgccttggctgccgccacggagcgtgtccgcgcgggaacgctgagccaggaggacgcgcaccacctgttcgaccaattgcttggccaagccgccgccgtcccggaacgcgggctcaacaactttcttgccgcactcgcccgtgctccaccctcagctgcctgccgcgatggccccggccttgccatcgccctcttcaaccgcatgtcccgaggcgctggtgcacgggtggcgtcgcccacgctctgtacctattccatcctcatggactgctgctgccgcgcaggccgcccggacttggtgcttgccttcttcggccgcctcctcaggttggggctgcgcttggatatcatctcctccagcaatctcctcaaggggctctgccaggccaagcgttcaaatgaggctttggacatgctgctccaccggatgcccgaactggactgtgtgcctgatgtcttctcgcacagcatagtaatcaacggctgttttaaacaaggtgaagtagacaaagcgtgcaatctcttccatcagatgccccaactgggagttcaacctaatgtggtgatctacaactcagttatcgacgcactaagcaaatccggagcaatggacaaggcagaagtggtccttcggcaaatggttgatcaaggaattgaacccaatatcaagacatataactgtctgatccatggatattctacttttggtcagtggaaggaggcacttagggtattcaaagaaatggcaagtcttggtgttgtaccagacgttgtcacgttgacctcattaatcgattccctttgcaagcacagaaggacaaaggaagctagagaaatttttgactctatggctgcaaagggcctgcctggttctgggttcttgctctcatggtcattttgtgaaagccaaggaattgatctc

SEQ ID NO: 1974 - DNA, 2337 bp, Triticum aestivum
  misc_feature (138)..(138): n is a, c, g, or t
atgtttatcaatttcgcaaacttttatcaaattcatgaactttttcgtcaaattcataaaaaaattcaaatcgatggaaaaaaattcaattttgcaaacttttttcaaatcgtcaactttttgttaaattcgtggacntttttttttttgcaagtgcatggaattgacgcccctgcggcacgggcgctagtcgctacatggtggcagaaatttgccgggttgcaactcacccgagaagaaaatgtgatgcatccctctgatccgatcttcggggcgccctggggatcaagaaatagcattgataagagtgcagctcacctgatgggtgtgagcattactcggaaagactcatcagaaaatcatcaagtgccattgtaccccaagcacacgcccccgccgccgccagactcgtcagccgcgtacgaggccgctcaccggcgggcaagtccaccggtcccgcctcctgcgttcacttcctcggcagcggcgctggttgctgcgcgcgcgccgagcgtcgcaggtgacaccaatcgatcgcggtgcgcctcttcagcggacgcacgcacatcccgcgtcgagctcggctggaatcggccagaaatgccagccgcccgcctgtcctccatctccacctcctccttcagggctccttcacgagcccccctcgccgccttggctgccgccacggagcgtgtccgcgcgggaacgctgagccaggaggacgcgcaccacctgttcgaccaattgcttggccaagccgccgccgtcccggaacgcgggctcaacaactttcttgccgcactcgcccgtgctccaccctcagctgcctgccgcgatggccccggccttgccatcgccctcttcaaccgcatgtcccgaggcgctggtgcacgggtggcgtcgcccacgctctgtacctattccatcctcatggactgctgctgccgcgtaggccgcccggacttggtgcttgccttcttcggtcgcctcctcaggttggggctgcgcttggatatcatctcctccagcaatctcctcaaggggctctgccaggccaagcgttcaaatgaggctttggacatgctgctccaccggatgcccgaactggactgtgtgcctgatgtcttctcgtacagcatagtaatcaacggctgttttaaacaaggtgaagtagacaaagcgtgcaatctcttccatcagatgccccaactgggagttcaacctaatgtggtgatctacaactcagttatcgacgcactaagcaaatccggagcaatggacaaggcagaagtggtccttcggcaaatggttgatcaaggaattgaacccaatatcaagacatataactgtctgatccatggatattctacttttggtcagtggaaggaggcacttagggtattcaaagaaatggcaagtcttggtgttgtaccagacgttgtcacgttgacctcattaatcgattccctttgcaagcacagaaggacaaaggaagctagagaaatttttgactctatggctgcaaagggcctgaaacctaatatcgtctcctactctactatgcttaatgggtatgtcaaagaaggatccttcgaggatatgactgatctcttcaattcgatggtacggaatggtgttgtaccaaaccaccatattttcaacatactgatcaatgcatatgctaaacgtggactgatggatgaggctatgcacatgttcgaagtaatgaggcaacaaggagtaaacccagatgtagttgactatctagtaataatggattcactttgtaaaatgggtaggatggatgctgctgtggacaaatttaatcagatggtcaatcaaggagtttcacctaacaaagctgtttaccaatgcctggttctgggttcttgctctcatggtcattttgtgaaagccaaggatttgatctctgaagcaattaatagaggtctgttttctaacagtgtgttcttctatcctgtaataaacgacctatgcaaagaaggaaaggtaaacgaggcacaggatatgtttgacttcattctaggtattggtcggcggcctgatgtgattatgtacaattcactgatggatggatattgccttgttggcaaggtggaggaagcactaagagtacttgatgctatgaagtctgctggcctccaacctactgctgttacgtatgctatacttcttaatggctactgtaaaattggcaggatcgccgatggattgagtcttttcagggaaatgtcactcagcggggttaaacccacgacttttatcaacaacaacaacaacaacaaagcctttagtcccaaacaagttggggtaggc

SEQ ID NO: 1975 - DNA, 2295 bp, Triticum aestivum
atgccaaccgcccgcctgtcctccatctccacctcctccttcagggcccccctcgccgccttggctgccgccacggaacgcgttctcgctggaacgctaagccgggaggatgcgcaccacctgttcgacgaattgctaggccaagccgccgccgccccggaacacgggctgaacaactttcttgccgcactcgcccgtgctccaccctcagctgcctgcagcgatggccccggccttgccatcgccctcttcaaccgcatgtcccgaggcgctggtgcacgggtggtgtcgcccacgctctgtacctattccatcctcatggactgctgctgccgtgcacgccgcccagagttggtggttgccttcttcggccgcctcctcaggttggggctgcgcttggatatcatctcctccagcaatctcctcaaggggctctgccaggccaagcgttcaaatgaggctttggacatgctgctccaccggatgcccgaactggactgtgcacctgatgtcttctcgttcaacatagtaatcaacggctgctttaaagaaggtgaagtagacaaagcgtgcaatctcttccatgagatgccccaactgggagttcaacctgatgtggtcacctacacctcaatcatcaacgcactaagcaagtctggagcaatggacaaggcagaagtggtccttcggcaaatggttgatcaaggcattggacccaacatcaggacatatactagcctgatacatggatattccgcttcgggtcagtggaaggcggcagctagagtattcaaagagatggtaagtcttggtgttctaccaaatgttgtcacatggaactcatttatggattcactttgcaagcatagaaggacaaaggaagctcgagatatttttgactccatggctgcaaagggtcaaaaacctgatattgtctcctactctattatgcttaacgggtacgcgaaagaaggatacttcgatgacatgactgatttgttcaattcgatgctacagaatggtattgtacctaatcaccatgttttcaacatattgattaatgcatatgctaaacgtggactgatggatgaggctatgcacatgtttgaagtaatgaggcaacaaggagtaaacccaaatgtagttagctatcaagtcataatggattcactttgtaaaatgggtaggatggatgctgctctggaaaaatttaatcagatggtcaatcaaggagtttcagctgacaaagctgtttaccgatgcctggttctgggttcttgttctcatggtgattttgtgaaggccaaggaattgatttctgaagccgttaatagaggtctgtgttctaacagtgtgttcttctattctgtaataaatgacctgtgcaaagaaggaaaggtgaaggaggcacaggatatgtttcacttcattgtaggtattggtcagcggcctgatgtgattatgtacacttcactgatggatggatattgccttgttggcaaggtggaggaagcactgagagtacttgatgctatgaagtctgctggcctccaacctactgctgttacgtatgctatacttcttaatggctactgtaaaattggcaggatcgccgatggattgagtcttttcaaggaaatgtcactcagcggggttaaacccacgactattatgtacaacattatacttgatgggctgtttcgctccgggagaacagtttctgcaaaggaaaaattctgtacgatgagcgaaagtggcataccagtgggcattgacacatacaacatagttcttagtggactttgtaaaaataattgcactggtgaagcaatagagctattcaagaaactacgtgcaatgaatgtgaagattgatgtcataacactcaatatcatgatttctgcaatgtttaaaactaggagaattgaagaagccaaggatttgtttgctactatatcagccatcgggttggtgccttctgttgtgacatacagcttaatgatgacaaacttcataaaagaagggttgctggcagaggctgatgatatgtttttagcagtggagaaggctaactgtgctcccaactccaggctgctaaatcatgtggtcagggtgttgctggaaaaaggtgcagttgtaaagggtgcaaattatctggctaaacttgatgcaaaacagatgtcacttgatgtttcaacgatttcgttaattgtgtctctcttctcaggggaagggaaattgagggagcacgtaaaattgcttccggtaaagtaccagcctcctgagaattccggc

SEQ ID NO: 1976 - DNA, 2295 bp, Triticum aestivum
atgccaaccgcccgcctgtcctccatctccacctcctccttcagggcccccctcgccgccttggctgccgccacggaacgcgttcgtgctggaacgctaagccgggaggatgcgcaccacctgttcgacgaattgctaggccaagccgccgccgccccggaacacgggctgaacaactttcttgccgcactcgcccgtgctccaccctcatctgcctgcagcgatggccccggccttgccatcgccctcttcaaccgcatgtcccgaggcgctggtgcacgggtggtatcgcccacgctctgtacctattccatcctcatggactgctgctgccgtgcacgccgcccagagttggtggttgccttcttcggccgcctcctcaggttggggctgcgcttggatatcatctcgtccagcaatctcctcaaggggctctgccaggccaagcgttcaaatgaggctttggacatgctgctccaccggatgcccgaactggactgtgcgcctgatgtcttctcattcaacatagtaatcaacggctgctttaaagaaggtgaagcagacaaagcgtgcaatctcttccatgagatgcctcaactgggagttcaacctgatgtggtcacctacacctcaatcatcaacgcactaagcaagtctggagcaatggacaaggcagaagtggtccttcggcaaatggttgatcaaggcattggacccaacatcaggacatatactagcctgatacatggatattccgcttcgggtcagtggaaggcggcagctagagtattcaaagagatggtaagtcttggtgttctaccaaatgttgtcacatggaactcatttatggattcactttgcaagcatagaaggacaaaggaagctcgagatatttttgactccatggctgcaaagggtcaaaaacctgatattgtctcctactctattatgcttaacgggtacgcgaaagaaggatacttcgatgacatgactgatttgttcaattcgatgctacagaatggtattgtacctaatcaccatgttttcaacatattgattaatgcatatgctaaacgtggactgatggatgaggctatgcacatgtttaaagtaatgaggcaacaaggagtaaacccaaatgtagttagctatcaagtcataatggattcactttgtaaaatgggtaggatggatgctgctctggacaaatttaatcagatggtcaatcaaggagtttcacctgacaaagctgtttaccgatgcctggttctgggttcttgttctcatggtgattttgtgaaggccaaggaattgatttctgaagctgttaatagaggtctgtgttctaacagtgtgttcttctattctgtaataaatgacctgtgcaaagaaggaaaggtgaaggaggcacaggatatgtttcacttcattgtaggtattggtcagcggcctgatgtgattatgtacacttcactgatggatggatattgccttgttggcaaggtggaggaagcactgagagtacttgatgctatgaagtctgctggcctccaacctactgctgttacgtatgctatacttcttaatggctactgtaaaattggcaggatcgccgatggattgagtcttttcaaggaaatgtcactcagcggggttaaatccacgactattatgtacaacattatacttgatggactgtttcgctccgggagaacagtttctgcaaaggaaaaattctgtacgatgagcgaaagtggcataccagtgggcattgacacacacaacatagttcttagtggactttgtaaaaataattgcactggtgaagcaatagagctgttcaagaaactacgtgcaatgaatgtgaagattgatgtcataacactcaatatcatgatttctgcaatgtttaaaactaggagaattgaagaagccaaggatttgtttgctactatatcagccatcgggttggtgccttctgttgtgacatacagcttaatgatgacaaacttcataaaagaagggttgctggcagaggctgatgatatgtttttagcagtggagaaggctaactgtgctcccaactccaggctgctaaatcatgtggtcagggtgttgctggaaaaaggtgcagttgtaaagggtgcaaattatctggctaaacttgatgcaaaacagatgtcacttgatgtttcaacgatttcgttaattgcgtctctcttctcaggggaagggaaattgagggagcacgtaaaattgcttccggtaaagtaccagcctcctgagaattccggc

SEQ ID NO: 1977 - DNA, 1713 bp, Triticum aestivum
atgccccaactgggagttcaacctgatgtggtgacctacaactcaattattgacgcactaagcaagtccggagcaatggacaaggcagaagtgctccttcggcaaatggttgatcaaggaattgaacccaatatcaggacatatagctgtctaatccatggatattctacttttggtcagtggaaggaggcacttagggtattcaaagaaatggcaagtcttggtgttgcaccagacgttgtcacgttgagctcattaatcgattccctttgcaagcacagaaggacaaagcaagctagagaaatttttgactctatggctgcaaagggcctgaaacctgatatcgtctcctactctactatgcttaatgggtatgtcaaagaaggatccttcgaggatatgactgatctcttcaattcgatggtacggaatggtattgtacctaatcaccatgttttcaacatactgatcaatgcatatgctaggcgtggactgatggatgaagctatgcacatgttcgaagtaatgaggcaacaaggagtaaacccggatgtagttagctatctagtagtaatggattcactttgcaaaatgggtaggatggatgctgctctggacaaatttaatcagatggtcaatcaaggagtttcacctaacaaagctgtttaccaatgcctggttctgggttctttctctcatggtgattttgtgaaagccaaggaattgatttctgaagcagttaatagaggtatgtgttctaacagtgtgttcttctatcctgtaataaacgacctttgcaaagaaggaaaggtaaaggaggcacaggatatgtttgacttcatcctaggtattggtcagcggcctgatgtgattatgtacacttcactgatggatggatattgccttgttggcaaggtggagaaagcactgagtgtactcgatgctatgaaatctgctggccttcaacctgatgatgttgtatatgctacacttcttaacggttactgtaaaattggaaggattgccgatggattgagccttttcagggaaatgtcactcagcggggttaagcccacgactattatatacaacattatactggatgggctgttttgctctgggagaacaggttttgcaaaggaaaaattccatacgatgactgaaagtggcataccagtaggcgttgacacatacaacatagttcttagtggactttgtagaaacaattgcactgatgaagcaatagaactgttcaagaaactacgtgcaacgaacgtgaagattgatgtcatgacactcaatatcatgatttctgcaatgtttaaaactaggagaattgaagaagctaaggatttgtttgctactatatcagccatcggattggtgccttctgttgtgacttacagtttaatgatgacgaatttcataaaagaagggttgttggcagacgctgatgatacctttttggtaatggagaaagctggctgtgctcccaactccagtctgctaaatcaggtggtcagggtgttgctggaaaaaggtgcagttgtaaaggctgcaacttatctcgctaaacttgatgctaaacagctgtcagttgaagcttcaacgatttcgttaatagtatctctcttctcaggggaagggaaactaagggagcatgtagagttgcttccagtaaagtaccagcctcctcagagttcggctgacaat

SEQ ID NO: 1978 - DNA, 2145 bp, Triticum aestivum
atgagccgccgcgttgtccccgtcggcagacgcatcttggagcagaacatcaagggccggtaccgcacgggacacattggcaccgtggatgcactccacctgtttgacgaattgctccaggttgctcagccctcctcgattgctgccatcaactgcctcctcaccgtcttcggccgtgattgccctgcgctcggcgtctccctcttcaaccgtgttgcaagaaccaaggtgcctctccagagtgtcacctatggcattctagtcaactgctgctgcggcgctggccgcttggacctcggttttgccgccatgggcaacatcattaagatgggttttatgaaagaatccgttgttgctttcagccacctactcaaggccatctgtgcggagaacaagacaagctatgcaatggacatcgtactccgagtaatgcctgagcttaactgcacacccaacattttctcctacagcattcttttcaagggtctctgcaacgacaagagaagccaagaggctctcgacctgattcacatcatggttgagcatggaggtagctgccaacctaatgtggtgtcctatagcaccgtaattgatggcttgttgaaagagggtgaagtgaacaaggcttacagtctattttgtgaaatgttacagaggggaatttcgccggatgttgtgacctgtagttcgattatttctggcatgtgcaagcttcatgcgatggacaaggctgaggacgttcttcaacagatgcttgatagaggaattctgccagatgttgctacatatactagtctaatgcatggatattattcattaggacagtgcgaggaggtggatcggattttcaaagaaatgtctagaaatggtgttcaaccagatattgtaacttacaatatacagatggattatctttgcaagagcggaagatgcgcagaagctaggaagatttttgattccatggtcagtttgggccaaaaaccagatgttactacctacaacgttctgcttcatgggtatgctatggaaagatcttttcatgatatgaattgtctcattgagttgatggatgataatggtatttcaccagatcattatggctacaacatactcatatctgcttatgctaaagaaaaaatggttgatgaagtaatgcatatatttacaaaaatgcggcagcaaggactgaaccctgatgtagcgaactatggagcggcagtaaacttgctttccaagattggccgaatggatgatgctatgtcccaattcaatcaaatgataactgaagggttagctcctgatatcatagttttcaccccccttattagtggtttctgttcttgtggcaaatgggagaaggttgatgaactattttctgagatgttggatcgcggcatctgtcccaacacagtgttcttcaacacaattatggaccgcctttgcaaaaatggaagggttatggaagcccaagatctcttcgacctgatggtacacatgggtgtgaagcctgatgtgtgtacttataacacactgataggtggatacttgttcgttggtaagatggatgaagtgagcaagttacttgacaatatggtctcaattggcatggaaccagatgttatcacctataacatactgattgatggttactctaagaatggaaggatagatgatgcattggttgttttcagggaaatgttggacaggaaggttaagccttgtgttatcacttttaatagtatgattggtgcattgcttaaatgtggtaggaaggcagaagccaaagatttgtttgacggtatctgggccaacggattagtgcccgacgttattacatatagcttaatgatacaaaaacttattgaagaaggttctctacaagagtctgatgatctattcctttctatggagaagaatggatgtgctgccgactcccgtatgctaaattctatggttagaagcttacttcagaaaggggaggtgcccagggctgggacttatctgtctaaaattgatgagaggaggttcacctttgaagcgtccacagctagcttgttggctgcacttgcgtcagggggaaaaagccaggaatataaggagttactccctgaaaaataccactattttctggaacagggcactgat

SEQ ID NO: 1979 - DNA, 2145 bp, Triticum aestivum; identical to SEQ ID NO: 1978

SEQ ID NO: 1980 - DNA, 2145 bp, Triticum aestivum; identical to SEQ ID NO: 1978

SEQ ID NO: 1981 - DNA, 2223 bp, Triticum aestivum
atgcctcgcttctcctccaccacgccaatgtcgccaccccgcctcctcctccggctcggcgcccgccactcctcctccacctctcatccctcacgcatctgggatccccacgccgccttcgccgctgcgacgcagcgggcgcgctctggcacgctcaccacggaggacgcacaccacctgtttgatgaattgctgcggcagggcaatcctgtccaggagcgtcccttgactaactttctggctgccctcgcccgcgcgcccgcgtccgcattctgcagcgatggccctgccctggccgtcgccctcttcggccgtttgtcccgaggcgccggacgacgggtggcgcagccaaatgtcttcacctatggcgtcctcatggactgctgctgccgtgcgcgccgcctggatctagcgatcgccttcttcgcccgtctcctcaagacgggactggaggcaaaccaagtcatcttctgcaccctcctcaagggactctgccacgcaaagcgctcagatgaggctttggacgtggtgcttcacaggatgcctgagctaggctgcacccccaacgtggtggcctataccacggtcatccacggcttcttgaaggaaggccaagtaggcaaggcatgcaatctattccatggaatggcgcagcagggcgttgcgcctgatgtggtgacatataactcggttatcgatgcgttgtgcaaggccagagcaatggacaaggcagagtatttcctttgtgaaatggttgataatggtgtcgtacctaataatgtgacatataatagcctcatccatggatattcctctttgggccatcagaaggaggctgttagggtgctgaaagaaatgacaagacagggtatcataccagatgtcattacctgcacctcactcatgaccttcctttgcaagaatggaaaaagcaaggaagctgcagaaatttttgattcaatgcccacgaagggcctgaaacatgacgccgtttcatatgctattctccttcatgggtatgccactgaaggatgcttggttgatatgattaatctcttcaattcgatggacagagactgtattctacctaactgtcatatcttcaacatactgatttatgcatatgctaaatctgggaagcttgataaggctatgcttatatttagagatatgcagaaacaaggagtgagtccagatgcagtcacatattcaaccgtaatacatgcattttgcaaaaagggtaggttggatgatgctgtgataaagtttaatcagatgattgatacaggagtacgaccggaagcatctgcttatcgttccctaatccagggtttttgtacacatggcgatttggtgaaagcaaaggaatatgttactgaaatgatgaagaaaggtatgcttcctcctgatattatgttcttcagttcaatcatgcagaaactatgcacagaaggaagggtaatagaagcacgagatatccttgacttgatagtgcgcattggtatgaggcctaatgttttcatatttaatatactgatcggtgggtactgcctagtctgcaagatggaggatgcaacaaaaatgtttgaggatatggtgtcatttggtttagaaccttgtaatattacgtatggtatacttattaatggctattgcaaaaatagaaggattgatgatgggcttattctgttccaagagatgctgcacaagggacttaaacctacaacttttaattataatgtcatactggatgggttatttctggctggacgaactgttgctgcaaaggaaaagtttgatgagatggttgaatctggagtaagtgtgtgcagtgatacatattcgatagttcttgctggactttgcagaaataattgctctagcgaagtaatcatgctgttccagaaattaagggcaatgaacatgaaattcaatattagaattgtcactatcatgattgatgccttctacaaggttcggcgaaaccaagaagctaaggatttgtttgctgcaataccatccaatggcttggtagctaatgttgttacctacagcataatgatgaaaagtcttataaaagaaggttcagtggaagaagctgacactctttttatcgatggagaagagcggctgtactgcaaactcttggatgttaaatcatattatcagaaggttactggaaagaggagagatagtcaaggctggaaattatatgtcgaaagt

SEQ ID NO: 1982 - DNA, 2223 bp, Triticum aestivum; identical to SEQ ID NO: 1981

SEQ ID NO: 1983 - DNA, 2223 bp, Triticum aestivum
atgcctcgcttctccaccaccacgccaatgtcgccaccccgcctcctcctccgactcggcgcccgccactcctcctccacctctcatccctcacgcatctgggatccccacgccgccttcgccgctgcgacgcagcgggcgcgctctggcacgctcaccacggaggacgcacaccacctgtttgatgaattgctgcggcagggcaatcctgtccaggagcgtcccttgactaactttctggctgccctcgcccgcgcgcccgcgtccgcattctgcagcgatggccctgccctggccgtcgccctcttcggccgtttgtcccgaggcgccggacgacgggtggcgcagccaaatgtcttcacctatggcgtcctcatggactgctgctgccgtgcgcgccgcctggatctagcgatcgccttcttcgcccgtctcctcaagacgggactggaggcaaaccaagtcatcttctgcaccctcctcaagggactctgccacgcaaagcgctcagatgaggctttggacgtggtgcttcacaggatgcctgagctaggctgcacccccaacgtggtggcctataccacggtcatccacggcttcttgaaggaaggccaagtaggcaaggcatgcaatctattccatggaatggcgcagcagggcgttgcgcctgatgtggtgacatataactcggttatcgatgcgttgtgcaaggccagagcaatggacaaggcagagtatttcctttgtgaaatggttgataatggtgtcgtacctaataatgtgacatataatagcctcatccatggatattcctctttgggccatcagaaggaggctgttagggtgctgaaagaaatgacaagacagggtatcataccagatgtcattacctgcacctcactcatgaccttcctttgcaagaatggaaaaagcaaggaagctgcagaaatttttgattcaatgcccacgaagggcctgaaacatgacgccgtttcatatgctattctccttcatgggtatgccactgaaggatgcttggttgatatgattaatctcttcaattcgatggacagagactgtattctacctaactgtcatatcttcaacatactgatttatgcatatgctaaatctgggaagcttgataaggctatgcttatatttagagatatgcagaaacaaggagtgagtccagatgcagtcacatattcaaccgtaatacatgcattttgcaaaaagggtaggttggatgatgctgtgataaagtttaatcagatgattgatacaggagtacgaccggaagcatctgcttatcgttccctaatccagggtttttgtacacatggcgatttggtgaaagcaaaggaatatgttactgaaatgatgaagaaaggtatgcttcctcctgatattatgttcttcagttcaatcatgcagaaactatgcacagaaggaagggtaatagaagcacgagatatccttgacttgatagtgcgcattggtatgaggcctaatgttttcatatttaatatactgatcggtgggtactgcctagtctgcaagatggaggatgcaacaaaaatgtttgaggatatggtgtcatttggtttagaaccttgtaatattacgtatggtatacttattaatggctattgcaaaaatagaaggattgatgatgggcttattctgttccaagagatgctgcacaagggacttaaacctacaacttttaattataatgtcatactggatgggttatttctggctggacgaactgttgctgcaaaggaaaagtttgatgagatggttgaatctggagtaagtgtgtgcagtgatacatattcgatagttcttgctggactttgcagaaataattgctctagcgaagtaatcatgctgttccagaaattaagggcaatgaacatgaaattcaatattagaattgtcactatcatgattgatgccttctacaaggttcggcgaaaccaagaagctaaggatttgtttgctgcaataccatccaatggcttggtagctaatgttgttacctacagcataatgatgaaaagtcttataaaagaaggttcagtggaagaagctgacactctttttatcgatggagaagagcggctgtactgcaaactcttggatgttaaatcatattatcagaaggttactggaaagaggagagatagtcaaggctggaaattatatgtcgaaagt

SEQ ID NO: 1984 - DNA, 2223 bp, Triticum aestivum; identical to SEQ ID NO: 1983

SEQ ID NO: 1985 - DNA, 930 bp, Triticum aestivum
atgcctgagctgggctgcacccctgacgtggtggcgtatagcacggtcatccatggcttcttcaaggaaggccaagtaggcaaggcatgcaatctgttccatggaatggcacagcagggcgttgcgcctgacgtggtgacatataactcggttattgatgcactgtgcaaggccagagcaatggacaaggcggagtatttccttggtcagatggttgatagtggtgtcgtacctaacaatgtgacatataatagcctcatccatggatattcctcttcaggccattcaaaggaggcggtcagggtgctgaaagatatgacaagtaagggtatcataccagatgtttttacttgcaactcgctcatggcctccctttgcaagaatggaagaagcaaagaagctgcagaaatttttaattcaatgtccatgaagggcctgaaacctaacaccatttcatatgctattctccttcatgggtatgccactgaaggatgcttggttgacatgatcaatctcttcaattcaatggctacagactgtattctacctaactgtcatatcttcaacatactgattaatgcatatgctaaatatgggaagcttgataaggctatgcttatatttaaagatatgcagaaacaaggagtgagtccagatgcagtcacatattcaaccgtaatacatgcattttgcaaaaagggtaggttggatgatgctgtgataaagtttaatcagatgattgatacaggagtactactggaagcatctgtttatcgttccctaatccagggtttttgtacacatggcgatttggtgaaagcaacggaatatgttactgaaatgatgaagaaaggtatgcttcctcctgatattatgttcttcagttcaatcatgcagaacctatgcacagaaggaagggtaatagaagca

SEQ ID NO: 1986 - DNA, 2145 bp, Triticum aestivum
atgagccgccgccttgtccccgttggcagacgcatcttggagcagaacatcaaggcttggtaccacgccggagacattggcaccaaggacgcactccaccggtttgacgaattgctccaggatgctgggtcctcctcgatccgtgccgtcaactatctccttactgttgtcggacgtgattgccctgcgctcggcgtctccctcttcaaccgcgtcgcaagggccaaggtggcacccaacagtatcacgtacaccatcctcgtcgactgctgctgccgtgctggccgcttggacctcggtttcgctgccatgggccacatcattaagatgggatttacagcagacgcgatcttctctttcagccacctactaaagtccatatgtgcggagaagaagaccagctatgcaatggacatcgtactccgagtaatgcctgagcttaactgcacaccggacattttctcctatagcattcttttcaagggtctctgcaacgagaagagaagccaagaggctcttgagctgattcacatcatggttgaggatggaggttgctgccgacctgatgtggtgtcctatagcaccgtaattgatggcctgttgaaagagggtgaggtggacaaggcttacggcctattctgtgaaatgctacagaggggaatttcgccggatgatgtgacctataactcaatcatctctggcatgtgcaaggttcatgcgatggacaaggctgaggaggttcttcaacagatgtttgatagaggaattctgccagatgttgccacatataatagtctaatacatggatattattcattaggaaggtgcaaagaggttgatcggattttcaaggaaatgtctagaaatggtgttcaaccagatattgtaacttacaatatacagatggattatctttgcaagaatggaagatgcacagaagctaggaagatttttgattccatagtcagtttgggccaaaaaccgactgttactacctatagcattttgcttcatgggtatgctctggaacgatcttttcatgagatgcattgtctcattgatttgatggtgggaaatggtattgcgccagatcattttgtctacaacatactcatatctgcatatgctaaagaagaaatgattggtgaggtaatgcatatatttaaaaaaatgcggcagcatggattgaaccctgatgtagcgaactatggagcggtagtaaacttactttccaagattggccgaatggatgatgctatgtcccaattcaatcaaatgataactgaagggttagctcctgatatcataattttcaccccccttattagtggtttctgttcttgtggcaaatgggagaaggttcatgaactattttctgagatgttggatcgcggcatctgtcccaacacagtgttcttcaacacaattatggaccgcctttgcaaaaatggaagggttatggaagcccaagatctcttcgacctgatggtacacatgggtgtgaagcctgatgtgtgtacttataacaaactgacaggtggatacttgttcattggtaagatggatgaagtgagcaagctacttgacaatatggtctcaattggcatggaaccagatgttatcacctataacatactgattgatggttactctaagaatggaaagataaatgatgcattggttttttttagggaaatgttggaagggaaggttaagccttctgttatcatttttaatattatgattggtgtgttgcttaaatgtggcaggaaggaagaagccaaagatttgtttgatggtatctgggccaaaggattagtgcctgatgttgttacatatagcttaatgatacaaaagcttatagaagaaggttctctacaagagtctaatgatctattcctttctatggagaagaatggatgtgctgccgactcccgtatgctaaatgctatagttagaagcttacttcagaaaggggaggtgcccagggctgggacttatctgtctaaaattgatgagaggaggttcacccttgaagcttccactgctagcttgttgactgcacttgtgtcaggggggaaaggccaggaatataaagagttgctcccggaaaaataccactcgtttctggaacagggcactgat

SEQ ID NO: 1987 - DNA, 2145 bp, Triticum aestivum; identical to SEQ ID NO: 1986

SEQ ID NO: 1988 - DNA, 2145 bp, Triticum aestivum; identical to SEQ ID NO: 1986

SEQ ID NO: 1989 - DNA, 2145 bp, Triticum aestivum; identical to SEQ ID NO: 1986

SEQ ID NO: 1990 - DNA, 2145 bp, Triticum aestivum; identical to SEQ ID NO: 1986

SEQ ID NO: 1991 - DNA, 2145 bp, Triticum aestivum; identical to SEQ ID NO: 1986

SEQ ID NO: 1992 - DNA, 2199 bp, Triticum aestivum
atgcgccgccgccttgtcaccgtcggcagacgcatcttggagcagaaaattcaagaccggcaccgtgccggagacattggcagacgcatcttggagcagaacatcaaggctcggtaccacgctggagacattggcaccgaggatgcactcaacctgttcgacgaattgatccaggttgctcagccctcctcgatcagggccatcaactgcctgctcaccgttgttggccgtgattgccctgcgctcggcgtctccctcttcaaccgtgttgcaagagccaaggtgcctccacacaatatcacctatggcattctagtcgactgctgctgccgtgctggccgcttggaccttggacacgctgccatgggacacgtcattaagttgggatttacagcagaagctatcatcaatttcagccacctactcaaggccatctgtgcagtgaagaagaccagctatgcaatggacatcgtactccgagtaatgcctgagtttaactgcacaccgaacattttctcctacagcattcttttcaagggtctttgcaatgaaaggagaagccaagaggctcttgagctgattaatattatggttgaggatggaggtagctgccaacctgatgtggtgacctataacactgtaattgatggcttgttgaaagagggtgaggtggaccaagcttacagcctattttctgaaatgctgcgtcagggggtatcaccgaatgttgtgacatgtaattcaatcatctctggcatgtgcaagcttcacgcgatggacaaggctgaggaggttcttcaacagatgcttgatagacgaattctgccagatgttgccacatataatagtctgatacatggatattattcattaggacagtgcgaagaggtggatcggattttcaaggagatgactacaaatggtgttcaaccagatattgtaacttacaatatacagatggattatctttgcaagaatggaagatgcgcagaagctaggaagatttttgattccatgatcagtttgggccaaaaacctactgttactacctacaacattctgcttcatgggtatgctatggaaagatcttttcatgatatgaattgtctcattgagttgatggatgataatggtatttcaccagatcattatggctacaacatactcatatctgcttatgctaaagaaaaaatggttgatgatgtattgcatatatttacaaaaatgcggcagcaaggattgaaccctgatgttgcgaactatggagcggtaataaacttgctttctagtattggccgaatggatgacgctatgtcccaatacaatcaaatgataaatgaagggttagctcctgatatcatagttttcaactcccttattagtggtttctattcttgtggcaaatgggagaaggttcatgaactattttctgagatgttggatcgcggcatctgtcccaacacagtgttcttgaacacaattatggaccgcctttgcaaaaatgaaagggttatggaagcccaagatctcttcgacctgatggtacacatgggtgtgaagcctgatgtgtggacttataacacactgataggtggatacttgtttgttggtaagatggatgaagtgaggaagttacttgacaatatgtgctcaattggcatggaaccagatgttgtcacctatagcatactgattgatggttactctaagaatggaagaatagatgatgcatttgttgttttcaaggaattgttgggagggaaggttaagccttgtgttatcacttttactattatgattggtgcgttgcttaaatgtggcaggaaggaagaagccaaagatttgtttgatggtatctgggccaacggattagtgcccaacgttattacatatagcttaatgatacaaaaccttatagaagaaggttctctacaagagtctgatgatctattcctttctatggagaagaatgggtgtgctgctgactcacgtatgctaaatgctatagttagaaggttacttcagagaggggagatgccaagggctgggacttatctgtctaaaattgacgaggggagcttcacccttgaagcttccacagctggcttattgactgcgcttgcttcaggggggaaatgtcaggaatataaggggttactgcctgaaaaatatcactcttttctggaacagggcactggt

SEQ ID NO: 1993 - DNA, 2199 bp, Triticum aestivum; identical to SEQ ID NO: 1992

SEQ ID NO: 1994 - DNA, 2145 bp, Triticum aestivum
atgaggcgccgcctcgtccccgtcggcagccgcctctcggagcggaacatcgagcaccggtaccgctccagaaacattggtaccgaggacgcactcaacctgttcgacgaattgatccaggtcgctgggccttcctcggtccgcgccatcaactgcctcctcaccgtcgtcggccgtgattgccccgcaatcggcgtctccctgttcaaccgtgttgcaagagccaaggtgcctccccacaatatcacctatggcattctagtcgactgctgctgccgtgctggccgcttggaccttggacatgctggcatggggcacgtcattaagttgggatttgcagcagaagccatcgtcaatttcagccacctactcaaggccatatgtgcggagaagaagaccagctatgcaatggacattgtactccggataatgcctgaatttaactgcatcccgaacattttctcatacagcattcttttgaagggtctttgcaacgagaagaggagccaagaggctctcgagctgattcacatgatgattgaccatggaggtagctgccaacctaatgtggtgtcctatagcaccgtacttgatggcttgttgaaagagggtgaggtgggcaaggcctacagcctattttgtgtcatgctacagaggggaatttcgccgaatgctgtgacctgcacttcaatcatctctggcatgtgcaaagttcatgcgatggacaaggcagaggaggttcttcaacagatgactaatagaggtattctgccaaatagtgccacatataatagtctgatacatggatattattcattaggatggtgcaaagaggtggatcgaattttgaaggaaatgtctaaaaatggtgttcaaccagatattataacttccaatatacagttggattatctttgcaagagcagaagatgcgcagaagctaggaagatttttgattccatggtcagtttgggccaaaaaccagatgttactacctacagcatactgcttcatgggtatgctatggaaaaatcttttcatgatatgctttgtctcattgatttgatggtaggtaatggtattgcaccaaatcattatgtctacaacatactcatatctgcatatgctaaagaagaaatggttgatgaagtaatgcatatatttacaaaaatgcggcagaaaggattgaaccctgatgcagtgagctatggaacagtaatagacttactttccaggattggtcgaatggatgatgctatgtcccagttcgctcaaatcataactgaagggttagctcctgatatcatagttttcaactcccttattagtggtttctgttcttgtggcaaatgggagaaggttcatgaactattttctgagatgttggatcacggcatctgtcccgacagagtgttcttcaacactgttatggatcacctttgcaaaaatggaagggttatggaagcccaagatgtgttcgacctgatggtacacatgggtgtgaagccttttgtccgtgattacaacacactgatacatggatactgtttagttggtaagatggatgaagggaggaagttacttgacaatatgttctcaattggcttgaaaccggatgatttcacctatagcatactgattgatggttactctaagaagggaaggatagatgatgcattgattattgtcagggaaatgttggacgggaaggttaagccttctattatcacttttaatattatgattggtgcgttgctgaaaggtggcagaaaggaagaagccaaagatttgtttgatggtatctgggccaaaggattagtgcccgatgttgttacatatagcttaatgatacaaaaacttatagaagaaggttctctacaagagtctgatgatctattcatttctatggagaagaatggatgtgctgccgactcccagatgctaaatgctatagttagaagcttacttcagaaaggggaggtgccgagggctgggacttatctgtctaaaattgatgagaggaggttcacccctgaagcttccactgctagcttgttgactgcacttgtgtcagaggggaaaggccaggaatataaggagttactccctgaaaaatatcactcttttctggaacagggcactgat

SEQ ID NO: 1995 - DNA, 2142 bp, Triticum aestivum
atgaggcgccgcctcgtccccgtcggcagccgcctcttggagcggaacatcgagcaccggtaccgctccagaaacattggtaccgaggacgcactcaacctgttcgacgaattgatccaggtcgctgggccttcctcggtccgcgccataaactacctcaccgtcgtcggccgtgattgccccgcaatcggcgtctccctgttcaaccgtgttgcaagagccaaggtgcctccccacaatatcacctatggcattctagtcgactgctgctgccgtgctggccgcttggaccttggacatgctggcatggggcacgtcattaagttgggatttgcagcagaagccatcgtcaatttcagccacctactcaaggccatatgtgcggagaagaagaccagctatgcaatggacattgtactccggataatgcctgaatttaactgcatcccgaacattttctcatacagcattcttttgaagggtctttgcaacgagaagaggagccaagaggctctcgagctgattcacatgatgattgaccatggaggtagctgccaacctaatgtggtgtcctatagcaccgtacttgatggcttgttgaaagagggtgaggtgggcaaggcctacagcctattttgtgtcatgctacagaggggaatttcgccgaatgctgtgacctgcacttcaatcatctctggcatgtgcaaagttcatgtgatggacaaggcagaggaggttcttcaacagatgactgatagaggtattctgccaaatagtgccacatataatagtctgatacatggatattattcattaggatggtgcaaagaggtggatcgaattttgaaggaaatgtctagaaatggtgtccaaccaaatgttgtaacttacaatatacagttggattatctttgcaagagcagaagatgcgcagaagctaggaagatttttgattccatggtcagtttgggccaaaaaccagatgttactacctacagcatactgcttcatgggtatgctatggaaaaatcttttcatgatatgctttgtctcattgatttgatggtaggtaatggtattgcaccaaatcattatgtctacaacatactcatatctgcatatgctaaagaagaaatggttgatgaagtaatgcatatatttacaaaaatgcggcagaaaggattgaaccctgatgcagtgagctatggaacagtaatagacttactttccaggattggtcgaatggatgatgctatgtcccagttcgctcaaatcataactgaagggttagctcctgatatcatagttttcaactcccttattagtggtttctgttcttgtggcaaatgggagaaggttcatgaactattttctgagatgttggatcgcggcatctgtcccgacagagtgttcttcaacactgttatggatcacctttgcaaaaatggaagggttatggaagcccaagatgtgttcgacctgatggtacacatgggtgtgaagccttttgtccgtgattacaacacactgatacatggatactgtttagttggtaagatggatgaagggaggaagttacttgacaatatgttctcaattggcttgaaaccggatgatttcacctatagcatactgattgatggttactctaagaagggaaggatagatgatgcattgattattgtcagggaaatgttggacgggaaggttaagccttctattatcacttttaatattatgattggtgcgttgctgaaaggtggcagaaaggaagaagccaaagatttgtttgatggtatctgggccaaaggattagtgcccgatgttgttacatatagcttaatgatacaaaaacttatagaagaaggttctctacaagagtctgatgatctattcatttctatggagaagaatggatgtgctgccgactcccagatgctaaatgctatagttagaagcttacttcagaaaggggaggtgccgagggctgggacttatctgtctaaaattgatgagaggaggttcacccctgaagcttccactgctagcttgttgactgcactagtgtcagaggggaaaggccaggaatataaggagttactccctgaaaaatatcactcttttctggaacagggcactgat

SEQ ID NO: 1996 - DNA, 2142 bp, Triticum aestivum; identical to SEQ ID NO: 1995

SEQ ID NO: 1997 - DNA, 2145 bp, Triticum aestivum
atgaggcgccgcctcgtccccgtcggcagccgcctcttggagcggaacatcgagcaccggtaccgctccagaaacattggtaccgaggacgcactcaacctgttcgacgaattgatccaggtcgctgggccttcctcggtccgcgccatcaactgcctcctcaccgtcgtcggccgtgattgccccgcaatcggcgtctccctgttcaaccgtgttgcaagagccaaggtgcctccccacaatatcacctatggcattctagtcgactgctgctgccgtgctggccgcttggaccttggacatgctggcatggggcacgtcattaagttgggatttgcagcagaagccatcgtcaatttcagccacctactcaaggccatatgtgcggagaagaagaccagctatgcaatggacattgtactccggataatgcctgaatttaactgcatcccgaacattttctcatacagcattcttttgaagggtctttgcaacgagaagaggagccaagaggctctcgagctgattcacatgatgattgaccatggaggtagctgccaacctaatgtggtgtcctatagcaccgtacttgatggcttgttgaaagagggtgaggtgggcaaggcctacagcctattttgtgtcatgctacagaggggaatttcgccgaatgctgtgacctgcacttcaatcatctctggcatgtggaaagttcatgcgatggacaaggcagaggaggttcttcaacagatgactaatagaggtattctgccaaatagtgccacatataatagtctgatacatggatattattcattaggatggtgcaaagaggtggatcgaattttgaaggaaatgtctaaaaatggtgttcaaccagatattataacttacaatatacagttggattatctttgcaagagcagaagatgcgcagaagctaggaagattttttattccatggtcagtttgggccaaaaaccagatgttactacctacagcatactgcttcatgggtatgctatggaaaaatcttttcatgatatgctttgtctcattgatttgatggtaggtaatggtattgcaccaaatcattatgtctacaacatactcatatctgcatatgctaaagaagaaatggttgatgaagtaatgcatatatttacaaaaatgcggcagaaaggattgaaccctgatgcagtgagctatggaacagtaacagacttactttccaggattggtcgaatggatgatgctatgtcccagttcgctcaaatcataactgaagggttagctcctgatatcatagttttcaactcccttattagtggtttctgttcttgtggcaaatgggagaaggttcatgaactattttctgagatgttggatcacggcatctgtcccgacagagtgttcttcaacactgttatggatcacctttgcaaaaatggaagggttatggaagcccaagatgtgttcgacctgatggtacacatgggtgtgaagccttttgtccgtgattacaacacactgatacatggatactgtttagttggtaagatggatgaagggaggaagttacttgacaatatgttctcaattggcttgaaaccggatgatttcacctatagcatactgattgatggttactctaagaagggaaggatagatgatgcattgattattgtcagggaaatgttggacgggaaggttaagccttctattatcacttttaatattatgattggtgcgttgctgaaaggtggcagaaaggaagaagccaaagatttgtttgatggtatctgggccaaaggattagtgcccgatgttgttacatatagcttaatgatacaaaaacttatagaagaaggttctctacaagagtctgatgatctattcatttctatggagaagaatggatgtgctgccgactcccagatgctaaatgctatagttagaagcttacttcagaaaggggaggtgccgagggctgggacttatctgtctaaaattgatgagaggaggttcacccctgaagcttccactgctagcttgttgactgcacttgtgtcagaggggaaaggccaggaatataaggagttactccctgaaaaatatcactcttttctggaacagggcactgat

SEQ ID NO: 1998 - DNA, 2142 bp, Triticum aestivum; identical to SEQ ID NO: 1995

SEQ ID NO: 1999 - DNA, 1902 bp, Triticum aestivum
atgcctaccgcccgcctgtcctccgtctccgcctcctccttcaaggcttcttcacgaaaaccacgagcccccctcgccgccttggctgctgccacggagcgtgtgcgcgccggaacactaagccaggaggacgcgcaccacctgttcgacgaattgctaggccaagctgccatcgtcccggaacgcgggctgaacaactttcttgccgcactagctcgtgcaccgccctcaggtgcctgcggcgatggccccacccttgccgtcaccctcttcaatcgcatgtcccgaggcgctggtgcacgggtggtgtcgcccacactctgtacctattccatcctcatggactgctgctgccgcgcaggccgcccggacttggtggttgccttctttggccgcctcatcaggttggggctgcgtttggagatcatctccttcagcaatctcctcaaggggctctgccaggccaagtgttcaaatgaggctttggacatgctgctccaccggatgcccgaactagactgtgcgcctcatgtcgtctcgtacaacatagtaatcaacggctgttttaaacaaggtgaagtggagaaagcgtgcaatctctaccgtgagatgatcaacctgggagttcaacctaatgtggtgacctacagctcatttatcaacgcactaagcaagtccggagcaatggacaaggcagaagtggtccttcggcaaatggttgatcaaggcattgcacccaatatcattacgtatactagtctgatccatggatattccacttcgggtcagttgaaagcagcagttagtatattcaaagaaatggcaagtgctggtgttcgaccaaattctgtcacgttgaactcatttattgattccctttgcaagcatagaaagacaaaggaagctagagatatttttgactccatggccgcaaagggccacaaacctgatattttctcctactctactatgcttaatgggtatgcgaaagaaggatgcttcgatgatatgactgatctcttcaattcgatggtacggaatggtatcgtacctgaccaccatgttttcaacatactgatcaatgcatatgctaaacgtggactgatggataaggctatgcacatgttcgaagtaatgaggcaacaaggagtaaacccaaatgtagttgactatggtatacttcttaatggctactgtaaaattggaaggatcgcccatggattgagtcttttcagggaaatgtcactcagcggggttaagcccacgactattatgtacaacattatacttgatgggctgtttcgctccgggagatcagtttctgcaaaggaaaaattcgacatgatgcttgaaagtggcataccagtgaacgttcgcacatacaacatagttctctgtggactttgtaaaaacaattgcactggtgaagcaatggagctgttcaagaaattacgtgcaatgaacgtgcagattgatgtcatgatactcaatactatgatttctgcaatgtttaaaactaggagaattgaagaagccaaggatttgtttgctactatatcagccatcaggttggtgccttctgttgtgacttacagtgtaatgatgacgaatttcataaaagaagggttgctggcagatgctgatgatatgtttttagaaatggagaaggctggatgtgctcccaactccagtctgctaaatcaagtggtcagggcgttgctggaaaaaggtgcagttgtaaaggctgcaacttatctcgctaaacttgatgctaaacagctgtcagttgaagcttcaacgattttgttaatagtatctctcttctcaggggaagggaaactaagggagcacatagagttgcttccagtaaagtaccagcctcctgagagttcgactgacaat

SEQ ID NO: 2000 - DNA, 2187 bp, Triticum aestivum
atggtcccgccctcgccgtcgccctcttcaaccgcgtgtgccgagaacaagccggcccgcgggtggcacctcacagtccacacctacggcatcctcatggactgctgctgccgcgcgtctcgcccggacctagggcttgccttctttggtcgcctcctcaggacgggcctcaagacaaatgagatcgtcgccagcaccttcctcaagtgcctctgctacacgaaacggacagaagaggctgggaacttgctgcttcataggatgcccgagctctgctgtgtgcctgatgccttctcatacaacattgttctgaagagcttatgtgacaatagcatgagtcagcgggggcttgacctgctccagatgatggcgaaagaaggaggtggctgctctcccaacgtggtggcatatagcacggtcatccatggcttctttaaggagggcgaaacaggcaaggcatgcaatctcttccatgaaatgatgcagcaaggtgttgtgcccaatgtgtggacgtatagctcgattattgatgcattgtgcaaggccagagcaatggacaaggcagagctagcccttcagcagatggttgccaatggtgctcaacccaatgaagtgacatataattgcatgatccatgggtattccacatccgggcggttgaaagaggctgctaaaatgttcagagaaatgaaaagccggggtcttacaccaaatattgttacctgcggctcgttaatgacttccctttgcaagcatggaagaagcaaagaagctagagaaatatttgattccatgactgccaaaggccacagagctgatgtcgtctcatactctattttgcttcatgggtatgccaatgaaggatgctttgctgatatgattgatctctttaattcaatggaaagcaacggtattgcagccgactgccgtgtttttaccatattaattgatgcctatgctaaacgtggaatgatggatgatgcaatgcacatatttacggaaatgcagcaacaaggtgtgagtccaaatgttgtcacatattcaactgtaatatcagcactttctagaatgggtaggttgaccgattctatggaaaaatttaatcagatggttgccttgggagtacagccggatagagctatttatcggtccctaattcagggcttttgtatgcatggtggtttggttaaagataaggagttggtttctcaaatgataaacaaaggtattcctcgtcctagcattgtgttcttcaattcagtaataaacagtatgtgcaaggaaggaagggttatggatgcacatgatatctttgacttggttatagacattggtgagaggcctgatgacattacatttaattcactgattgacggatattgcttagtcgggaagatggataaagcatttaaaatactcgatgccatggaatcagttggtgttcagcctaatattgttacttacaacacacttcttgatggctattttaaaaatggaaggatcaatgatggtttgactctgtttagagaaatgccgcgtaagagaattaaacctgacactgttacatatggcatcatgttggatgggttgtttcgtgctgggagaactgttgctgcaaggacaatgttccatgagatgatcgaaagtggaataacagtggacatccccacatacaatatagttcttaggggactttctagaaataactgcacagatgaagcaatcgccctgttccagaaattaggtgcaatgagtgtgaagttcaatatttcaatatttaataccatgatcgatgcaatgtacaaggttcggagaagagaagaagccaatgatttatttgctgcaatatcagccagtgggttggtgcccaaggaatctacttatgcagtaatgataataaatcttctaaaacatggagcagtggaagaagcagacaatatgttttcatcaatggagaaaactggtatagtccccagctcccgtctattaaattgtatcatcagaatgttgttggaaataggtgagattgccaaggccggaaattacttgtctaaacttgatgggaacagcatctcactcgaagcttcaactacttcattgatgttgtctctgttttcaaagaaagggaaatatcatgaggacatgaaattgctccctgcaaagtatcaatttttcgatggatgtagt

SEQ ID NO: 2001 - DNA, 2148 bp, Triticum aestivum
atgttttctgttttcatttttgctttagttttttacgttcacctcgccatcgccctcttcaaccgcatgtgtcgagagcaatccggcccgcgggtggtgcctctcacagtccacacgtacaacatcctcatggactgctgctgccgcgcgtctcgcccggacctaggtcttgccttcttcgctcgcctcctcaggacaggcctgaagacaaacgagatcaccgccaacaccttcctcaagtgcctctgctacgcaagacggacggatgaggctctgaacgtgctgcttcataggatgttcgagctcggctgtgtgcctgatgccatctcatacaacattgttctgaagagcttatgtgaagatagcatgagtcagcgggcgctcgacctcctccagatgatggcgaaagaaggaggtggctgctcccccaacgtggtggcgtatagcacggtcatccatggcttttttaaggaaggtgaaacaggcaaggcatgcaatctgttccatgaaatgatgcaccaaggtgttgagcccagtgtgtggacatatagctcaatcattgatgcattgtgcaaggccagagcaatggacaaggcagagctagtgcttcagcagatggttaacaaaggtgttctacccaataatgtgacatataattgcatgatccatggatattccacatctgggcagtggaaagaggctgctaaattgcttagagaaatgaaaagccgggaccttataccagatattgtcactcgcaactcgttcctggcctccctttgcaagcatgggagaagcaaggaagctgcagaatttcttgattccatgactgccaagggccacaaaccagatatcgtatcataccgtattttgtttcatgggtatgccagtgaaggatgcttcgctgatatgattgatctctttaattcaatggaaagcaacggtattgcagctgactgccatgttttcaacatattaattagtggatatgcaaaacgtggaatgacagaagaagctatgctgatatttactgaaatgcggggacaaggagtgagtccagatgtagtcacctattccattgtaatagccgcactttccagaatgggtaggctgaccgatgctattgagaaattcaatgagatgactgccttggaagtacatccggacacaactgtttatcactcactgattcagggttgttgcatagacggtgatttggttaaagctaaggagctgatgcttgaaatgatgaacggtggtattcttcggcctaacattgtgttcttcaattcagtaataaatagtctgtgcaaagaaggaagggttatggatgcacatgatgtcttagacttggttataggcataggtgagaggcctgataccattacatttagttcactgattgacggatattgcttagtcgggaagacggataaagcattcaaaatacttgatgccatggaatcagttggtgttgagcctgatattgttacttacaatacactgcttgatggctattttaaaaacagaaggattgatgatgctttgactttgtttagagaaatgccgcgtaagagaattaaacctggcactgttacatatggcatcatgttggatgggttgtttcgtgctgggagaactgttgccgcaaagaaaatgttccatgagatgaacgggagtggaacaacggtggacatttccacatacgctataatacttggaggtttttgtagaaataattgtgcagacgaagctatcaccctgttccacaaattaggtgcaatgaatgtgaagttcaatattgcaatagtcaataccatgatcaatgcaatgtacaaggttgggagaagagaagaagctaaggaactatttgctggaatattagcccgtgggttggtgcctaatgaatctacttacggagtaatgataaaaaatcttctaaaagatggagcagtggaagatgctaacaatgtgttttcatcaatggacaagagtggtatagtccccagctcccgtctcatcaatgacatcatcagattgttgttggaaaaaggcaacgaaaaaaatagcgcgctacaaaatatagcgaggcccttctccaaatgctacacaagttatagcgcgctaatagcatgctatatttcgaaa

SEQ ID NO: 2002 - DNA, 2148 bp, Triticum aestivum
atgttttctgttttcatttttgctttagttttttacgttcacctcgccatcgccctcttcaaccgcgtgtgtcgagagcaatccggcccgcgggtggtgcctctcacagtccacacgtacaacatcctcatggactgctgctgccgcgcgtctcgcccggacctaggtcttgccttcttcgctcgcctcctcaggacaggcctgaagacaaacgagatcaccgccaacaccttcctcaagtgcctctgctacgcaagacggacggatgaggctctgaacgtgctgcttcataggatgtccgagctcggctgtgtgcctgatgccatctcatacaacattgttctgaagagcttatgtgaagatagcatgagtcagcgggcgctcgacctcctccagatgatggcgaaagaaggaggtggctgctcccccaacgtggtggcgtatagcacggtcatccatggcttttttaaggaaggtgaaacaggcaaggcatgcaatctgttccatgaaatgatgcaccaaggtgttgaacccagtgtgtggacatatagctcaatcattgatgcactgtgcaaggccagagcaatggacaaggcagagctagtgcttcagcagatggttaacaaaggtgttctacccaataatgtgacatataattgcatgatccatggatattccacatctgggcagtggaaagaggctgctaaattgcttagagaaatgaaaagccaggaccttataccagatattgtcactcgcaactcgttcctggcctccctttgcaagcatgggagaagcaaggaagctgcagaatttcttgattccatgactgccaagggccacaaaccagatatcgtatcataccgtattttgtttcatgggtatgccagtgaaggatgcttcgctgatatgattgatctctttaattcaatggaaagcaacggtattgcagctgactgccatgttttcaacatattaattagtggatatgcaaaacgtggaatgacagaagaagctatgctgatatttactgaaatgcggggacaaggagtgagtccagatgtagtcacctattccattgtaatagccgcactttccagaatgggtaggctgaccgatgctattgagaaattcgatgagatgactgccttggaagtacatccggacacaactgtttatcactcactgattcagggttgttgcatagacggtgatttggttaaagctaaggagctgatgcttgaaatgatgaacggtggtattcttcggcctaccattgtgttcttcaattcagtaataaacagtctgtgcaaagaaggaagggttatggatgcacatgatgtcttagacttggttataggcataggtgagaggcctgataccattacatttagttcactgattgacggatattgcttagtcgggaagacggataaagcattcaaaatacttgatgccatggaatcagttggtgttgagcctgatattgttacttacaatacactgcttgatggctattttaaaaacagaaggattgatgatgctttgactttgtttagagaaatgccgcgtaagagaattaaacctggcactgttacatatggcatcatgttggatgggttgtttcgtgctgggagaactgttgccgcaaagaaaatgttccatgagatgaacgagagtggaacaacggtggacatttccacatacgctataatacttggaggtttttgtagaaataattgtgcagacgaagctatcaccctgttccacaaattaggtgcaatgaatgtgaagttcaatattgcaatagtcaataccatgatcaatgcaatgtacaaggttgggagaagagaagaagctaaggaactatttgctggaatattagcccgtgggttggtgcctaatgaatctacttacggagtaatgataaaaaatcttctaaaagatggagcagtggaagatgctaacaatgtgttttcatcaatggacaagagtggtatagtccccagctcccgtctcatcaatgacatcatcaaattgttgttggaaaaaggcaacgaaaaaaatagcgcgctacaaaatatagcgaggcccttctccaaatgctacacaagttatagcgcgctaatagcatgctatatttcgaaa

SEQ ID NO: 2003 - DNA, 2148 bp, Triticum aestivum; identical to SEQ ID NO: 2001

SEQ ID NO: 2004 - DNA, 2148 bp, Triticum aestivum; identical to SEQ ID NO: 2001

SEQ ID NO: 2005 - DNA, 2148 bp, Triticum aestivum; identical to SEQ ID NO: 2002

SEQ ID NO: 2006 - DNA, 2148 bp, Triticum aestivum; identical to SEQ ID NO: 2001

SEQ ID NO: 2007 - DNA, 2199 bp, Triticum aestivum
atgtcccgcctccgccactccacctccaccgcgccgatgtttcacctccgcctcctccgctgccgcttctcctccatccccatctctccgccctcgcgctcatggtctcccgtcaccgcctttgccgcggccacagagcgcgtcagcgctgggacgctcagcccggaagacgcacaccgcctgttcgacgaattgctacggcaggccactccggtccccgcgcgctccctgaacggcttacttacggccctctcccgtgcgccggacaccggcgcctgcagagacggccccgccctcgccctcgccctcttcaaccgcacccgccgagaagaggccggctcctgggtggtgccgtccacaatcttcacctacggcatcctcatgaactgctgctgccgcacgcgtcgtccggaacttgggcttgccttctttgggcgcgtcctcaggatgggcctgaggacaaacgtggtcgtcgccaccacggtcctccagtgcctgtgcggcgccaaacggacagatgaggctgtggacatcctgctacatcggatgtccgagctcgggtgcgtgcctgacgacttctcatacaacattgttctgaagagcttatgcgatgatagcaggagccagcgggcactcgacctgctccggatgtgggagaatgaacgaggtgtctgctcccccaacgtatatacgtataacacggtcatccacggcttctttaaggaaggtgaagtaagcaaggcatgtaacctattccatgaaatggcgcagaaaggggttccgcccaatgtggtgacatatagcttgactattgatgcgctgtgcaaggccagagctatggacaaagcacagttgttcctccggcagatgattcataaaggtgttcgaccgaacaatgtgacatataatgtcatgatccatggatattgcactctgggacagtggaaggaagcgggtaaaatgttcagagaaatgacaagacagggtctcataccagatattgttacttggacctcgttcatggcctctctctgtaagcatggaagaaccaaagaagctgccgaattctttgattccatgactgccaagggccacaagcctgatttggtcatgtatcatgttctgctccatgggtatgcaaccgaaggatgctttgctgatatgattaatctctttaattcaatggcaaccaaaggtattgtacccgatcgtcaggttttcaacattttaattgatgcacatgctaaacatggaatgatggatgaagctatgcacatatttactggaatgcagggacaaggagtgtgtccagatgtagggacctattcaactctaatatctgcactttgcagaatgggtaggctggctgatgccatggataacttcagtcagatgattggtaagggagtacaaccgaacacagttgtttatcactccctaattcagggtttctctacacatggtgatttgaggaaagcaaaggagttggtttatgaaatgacgaataaaggtattccttgtccaaacattgcattcttcagttctataatggacagtctatgcaaagaaggaagggttatggatgcacatgatatcttccacttggttacagacataggtctgaaacctaacatcattacgtttaatacgctgattgatggacattgcttagtcggtgagatggagaaagcatttggagtacttgattccatggtatcagctggcattgaggctgatgtttttacatataatacacttgcttatggctattgtagatgtggaaggattgatgatgggttgattctattcagagaaatgttgcaaaacaaacctaaacccacaacaatcacatataacatcatactggatgggttatttcgtgctgggagaacatttgctgcaaagaaaatgttccttgagatgattgaaacgggaataacagtgagcatttccacatacagtataatacttggaggactttgtaggaataattgctctgacgaagcgatcaccctatttcagaaattaggagcaatgaatgtgaagtttgatattaaaatactcactaccatgatcaatgccatgttcaaggtttggagaagagaagaagctaacggtttgtttgctgcaatatcagccagtgggatggtacctaatgctgataggaaatcttctaaaagaaggatcagtggaagaagc

SEQ ID NO: 2008 - DNA, 2199 bp, Triticum aestivum
atgtcccgcctccgccactccacctccaccgcgccgatgtttcacctccgcctcctccgctgccgcttctcctccatccccatctctccgccctcgcgctcatggtctcccgtcaccgcctttgccgcggccacagagcgcgtcagcgctgggacgctcagcccggaagacgcacaccgcctgttcgacgaattgctacggcaggccactccggtccccgcgcgctccctgaacggcttacttacggccctctcccgtgcgccggacaccggcgcctgcagagacggccccgccctcgccctcgccctcttcaaccgcacccgccgagaagaggccggctcctgggtggtgccgtccacaatcttcacctacggcatcctcatgaactgctgctgccgcacgcgtcgtccggaacttgggcttgccttctttgggcgcgtcctcaggatgggcctgaggacaaacgtggtcgtcgccaccacggtcctccagtgcctgtgcggcgccaaacggacagatgaggctgtggacatcctgctacatcggatgtccgagctcgggtgcgtgcctgacgacttctcatacaacattgttctgaagagcttatgcgatgatagcaggagccagcgggcactcgacctgctccggatgtgggagaatgaacgaggtgtctgctcccccaacgtatatacgtataacacggtcatccacggcttctttaaggaaggtgaagtaagcaaggcatgtaacctattccatgaaatggcgcagaaaggggttccgcccaatgtggtgacatatagcttgactattgatgcgctgtgcaaggccagagctatggacaaagcacagttgttcctccggcagatgattcataaaggtgttcgaccgaacaatgtgacatataatgtcatgatccatggatattgcactctgggacagtggaaggaagcgggtaaaatgttcagagaaatgacaagacagggtctcataccagatattgttacttggacctcgttcatggcctctctctgtaagcatggaagaaccaaagaagctgccgaattctttgattccatgactgccaagggccacaagcctgatttggtcatgtatcatgttctgctccatgggtatgcaaccgaaggatgctttgctgatatgattaatctctttaattcaatggcaaccaaaggtattgtacccgatcgtcaggttttcaacattttaattgatgcacatgctaaacatggaatgatggatgaagctatgcacatatttactggaatgcagggacaaggagtgtgtccagatgtagggacctattcaactctaatatctgcactttgcagaatgggtaggctggctgatgccatggataacttcagtcagatgattggtaagggagtacaaccgaacacagttgtttatcactccctaattcagggtttctctacacatggtgatttgaggaaagcaaaggagttggtttatgaaatgacgaacaaaggtattccttgtccaaacattgcattcttcagttctataatggacagtctatgcaaagaaggaagggttatggatgcacatgatatcttccacttggttacagacataggtctgaaacctaacatcattacgtttaatacgctgattgatggacattgcttagtcggtgagatggagaaagcatttggagtacttgattccatggtatcagctggcattgaggctgatgtttttacatataatacacttgcttatggctattgtagatgtggaaggattgatgatgggttgattctattcagagaaatgttgcaaaacaaacctaaacccacaacaatcacatataacatcatactggatgggttatttcgtgctgggagaacatttgctgcaaagaaaatgttccttgagatgattgaaacgggaataacagtgagcatttccacatacagtataatacttggaggactttgtaggaataattgctctgacgaagcgatcaccctatttcagaaattaggagcaatgaatgtgaagtttgatattaaaatactcactaccatgatcaatgccatgttcaaggtttggagaagagaagaagctaacggtttgtttgctgcaatatcagccagtgggatggtacctaatgctgataggaaatcttctaaaagaaggatcagtggaagaagc

SEQ ID NO: 2009 - DNA, 2199 bp, Triticum aestivum; identical to SEQ ID NO: 2008

SEQ ID NO: 2010 - DNA, 2199 bp, Triticum aestivum; identical to SEQ ID NO: 2008

SEQ ID NO: 2011 - DNA, 2199 bp, Triticum aestivum
atgtcccgcctccgccactccacctccaccgcgccgatgtttcacctccgcctcctccgctgccgcttctcctccatccccatctctccgccctcgcgctcatggtctcccgtcaccgcctttgccgcggccacagagcgcgtcagcgctgggacgctcagcccggaagacgcacaccgcctgttcgacgaattgctacggcaggccactccggtccccgcgcgctccctgaacggcttacttacggccctctcccgtgcgccggacaccggcgcctgcagagacggccccgccctcgccctcgccctcttcaaccgcacccgccgagaagaggccggctcctgggtggtgccgtccacaatcttcacctacggcatcctcatgaactgctgctgccgcacgcgtcgtccggaacttgggcttgccttctttgggcgcgtcctcaggatgggcctgaggacaaacgtggtcgtcgccaccacggtcctccagtgcctgtgcggcgccaaacggacagatgaggctgtggacatcctgctacatcggatgtccgagctcgggtgcgtgcctgacgacttctcatacaacattgttctgaagagcttatgcgatgatagcaggagccagcgggcactcgacctgctccggatgtgggagaatgaacgaggtgtctgctcccccaacgtatatacgtataacacggtcatccacggcttctttaaggaaggtgaagtaagcaaggcatgtaacctattccatgaaatggcgcagaaaggggttccgcccaatgtggtgacatatagcttgactattgatgcgctgtgcaaggccagagctatggacaaagcacagttgttcctccggcagatgattcataaaggtgttcgaccgaacaatgtgacatataatgtcatgatccatggatattgcactctgggacagtggaaggaagcgggtaaaatgttcagagaaatgacaagacagggtctcataccagatattgttacttggacctcgttcatggcctctctctgtaagcatggaagaaccaaagaagctgccgaattctttgattccatgactgccaagggccacaagcctgatttggtcatgtatcatgttctgctccatgggtatgcaaccgaaggatgctttgctgatatgattaatctctttaattcaatggcaaccaaaggtattgtacccgatcgtcaggttttcaacattttaattgatgcacatgctaaacatggaatgatggatgaagctatgcacatatttactggaatgcagggacaaggggtgtgtccagatgtagggacctattcaactctaatatctgcactttgcagaatgggtaggctggctgatgccatggataacttcagtcagatgattggtaagggagtacaaccgaacacagttgtttatcactccctaattcagggtttctctacacatggtgatttgaggaaagcaaaggagttggtttatgaaatgacgaacaaaggtattccttgtccaaacattgcattcttcagttctataatggacagtctatgcaaagaaggaagggttatggatgcacatgatatcttccacttggttacagacataggtctgaaacctaacatcattacgtttaatacgctgattgatggacattgcttagtcggtgagatggagaaagcatttggagtacttgattccatggtatcagctggcattgaggctgatgtttttacatataatacacttgcttatggctattgtagatgtggaaggattgatgatgggttgattctattcagagaaatgttgcaaaacaaacctaaacccacaacaatcacatataacatcatactggatgggttatttcgtgctgggagaacatttgctgcaaagaaaatgttccttgagatgattgaaacgggaataacagtgagcatttccacatacagtataatacttggaggactttgtaggaataattgctctgacgaagcgatcaccctatttcagaaattaggagcaatgaatgtgaagtttgatattaaaatactcactaccatgatcaatgccatgttcaaggtttggagaagagaagaagctaacggtttgtttgctgcaatatcagccagtgggatggtacctaatgctgataggaaatcttctaaaagaaggatcagtggaagaagc

SEQ ID NO: 2012 - DNA, 2199 bp, Triticum aestivum; identical to SEQ ID NO: 2011

SEQ ID NO: 2013 - DNA, 2148 bp, Triticum aestivum
atgagccgccgccttgtccccgtcggcagacgcatcttggagcagaacatcaaggaccggtaccgcaccggacacattggcaccgaggatgcactccagctgtttgacgaattgctccaggttgctcagccctcctcgattgctgccatcaactgcctcctcactgtcgtcggccgtgattgccctgcgctcggcgtctcgctcttcaaccgcgtcgcaaggtccaaggtggcgcccagcagtatcacctatgccattctggtcgactgctgctgccgcgctggccgccaggaccttggacacactgccatgggacacgtcatcaagatgggatttcttgcagatgctattatcactttcagccacctactaaaggccatctgtgcggagaacaagaccagctacgcaatggacatcgtactccgagtaatgcccatgtttaactgtgttccgagcattttctcctacagcattcttttcaagggtctctgcaatgagaggagaagccaagaggctcttgagctgattaacattatggttgaggatggacgaggtagctgccaacctaatgtcgtgtcctataccaccgtaattgatggcttgttgaaagagggtgaggtgggcaaggcctacagcctattttgtgtcatgctacagaggggaatttcgccgaatgttgtgacctgcacttcaatcatctctggcatgtgcaaagttcatgcgatggacaaggcagaggaggttcttcaacagatgactaatagaggtattctgccaaatagtgccacatataatagtctgatacatggatattattcattaggacagtgcgaagaggtggatcggattctcatggaaatgtctagaaatggtgttcaaccaaatgttgtaacttacaatatacagatggattatctttgcaagagcggaagatgtgcagaagctaggaagatttttgattctatgatcagtttgggcccaaaaccgaccattactacctacaacattctgcttcatgggtatgctatggaaaaatcttttcatgatatgcattctctcattgatttgatggtaggaaatggcattgcaccagatcattatgtctacaacatactcatatctgcatgtgctaaagaagaaatggttagtgaggtaatgcatatatttaaaaaaatgcggcagcatgggttgaaccctgatgtagcgacctatggagcggtagtaaacttgctttgcagcatgggccgaatggatgatgctatgtaccaatacaatcaaatgataaccgaaggattagctcctgatatcatagttttcagcacccttataagtggtttctgtacttgtggcaaatgggagaaggttcatgaactattttctgagatgttggatcgcggtatctgtcccaacacagtgttcttcaccacaattatggaccgcctttgcaaaaacggaagggttatggaagcccaagatctcttcgacctgatggtacacatgggtgtgaagcctgatgtgtgtacttataacacactgataggtggattcttgttcattggtaagatggatgaagtgaggaagttacttgacaatatggtctcaattggcatgaaaccagatgttatcacctataacatactgattgatggttactgtaagaatggaaggatagatgatgcattggttgttttcagggaaatgttggccgggaaggttaagccttgcattatcacttttaatattatgcttggtgcgttgcttaaaggtggcaggaaggaagaggctaaagatttgtttgatggtatctgggccaaaggattagtgcccaccgttgttacatatagcttaatgatacaaaaacttatagaagaaggatctctacaagagtctgatgatctattcctttctatggagaagaatggttgtcctgccaattcccgcatgctaaatgctatagttagaaggttacttcagaaaggggagatgcccagggctgggacttatttgtctaaaattgatgagaggagtttcaccattgaagcttccacagctagcttgttgactgcacttgcttcagtggggaaatgtcaggaatataaggggttactgcctgaaaaatatcactcttttctggaacagggcactgat

SEQ ID NO: 2014 - DNA, 2148 bp, Triticum aestivum
atgagccgccgccttgtccccgtcggcagacgcatcttggagcagaacatcaaggaccggtaccgcaccggacacattggcaccgaggatgcactccagctgtttgacgaattgctccaggttgctcagccctcctcgattgctgccatcaactgcctcctcactgtcgtcggccgtgattgccctgcgctcggcgtctcgctcttcaaccgcgtcgcaaggtccaaggtggcgcccagcagtatcacctatgccattctggtcgactgctgctgccgcgctggccgccaggaccttggacacactgccatgggacacgtcatcaagatgggatttcttgcagatgctattatcactttcagccacctactaaaggccatctgtgcggagaacaagaccagctacgcaatggacatcgtactccgagtaatgcccatgtttaactgtgttccgagcattttctcctacagcattcttttcaagggtctctgcaatgagaggagaagccaagaggctcttgagctgattaacattatggttgaggatggacgaggtagctgccaacctaatgtcgtgtcctataccaccgtaattgatggcttgttgaaagagggtgaggtgggcaaggcctacagcctattttgtgtcatgctacagaggggaatttcgccgaatgttgtgacctgcacttcaatcatctctggcatgtgcaaagttcatgcgatggacaaggcagaggaggttcttcaacagatgactaatagaggtattctgccaaatagtgccacatataatagtctgatacatggatattattcattaggacagtgcgaagaggtggatcggattctcatggaaatgtctagaaatggtgttcaaccaaatgttgtaacttacaatatacagatggattatctttgcaagagcggaagatgtgcagaagctaggaagatttttgattctatgatcagtttgggcccaaaaccgaccattactacctacaacattctgcttcatgggtatgctatggaaaaatcttttcatgatatgcattctctcattgatttgatggtaggaaatggcattgcaccagatcattatgtctacaacatactcatatctgcatgtgataaagaagaaatggttagtgaggtaatgcatatatttaaaaaaatgcggcagcatgggttgaaccctgatgtagcgacctatggagcggtagtaaacttgctttgcagcatgggccgaatggatgatgctatgtaccaatacaatcaaatgataaccgaaggattagctcctgatatcatagttttcagcacccttataagtggtttctgtacttgtggcaaatgggagaaggttcatgaactattttctgagatgttggatcgcggtatctgtcccaacacagtgttcttcaccacaattatggaccgcctttgcaaaaacggaagggttatggaagcccaagatctcttcgacctgatggtacacatgggtgtgaagcctgatgtgtgtacttataacacactgataggtggattcttgttcattggtaagatggatgaagtgaggaagttacttgacaatatggtctcaattggcatgaaaccagatgttatcacctataacatactgattgatggttactgtaagaatggaaggatagatgatgcattggttgttttcagggaaatgttggccgggaaggttaagccttgcattatcacttttaatattatgcttggtgcgttgcttaaaggtggcaggaaggaagaggctaaagatttgtttgatggtatctgggccaaaggattagtgcccaccgttgttacatatagcttaatgatacaaaaacttatagaagaaggatctctacaagagtctgatgatctattcctttctatggagaagaatggttgtcctgccaattcccgcatgctaaatgctatagttagaaggttacttcagaaaggggagatgcccagggctgggacttatttgtctaaaattgatgagaggagtttcaccattgaagcttccacagctagcttgttgactgcacttgcttcagtggggaaatgtcaggaatataaggggttactgcctgaaaaatatcactcttttctggaacagggcactgat

SEQ ID NO: 2015 - DNA, 2148 bp, Triticum aestivum; identical to SEQ ID NO: 2014

SEQ ID NO: 2016 - DNA, 2148 bp, Triticum aestivum; identical to SEQ ID NO: 2014

SEQ ID NO: 2017 - DNA, 1836 bp, Triticum aestivum
atgggacacgtcattaagttgggatttacagcagaagctatcgtcaatttcagccacctactcaaggccatctgtgcagtgaagaagaccagctatgcaatggacatcgtactccggataatgcctgagtttaactgcataccaaacattttctcctataacattcttttcaagggtctctgcaacgagaagagaagccaagaggctctcgacctgattcgcatcatggttgagcatggaggttgctgccaacctgatgtggtgacctataacactgtaatcgatggcttgttgaaagagggtgaggtaggcaaggcttacagcctattttgtgaaatgctgcgtcagggggtatcgccggatgttgtgacctgtagttcgattatctctggcatgtgcaagcttcatgcaatggacaaggctgaggaggttcttcaacagatgcttgatagaagaattctgccagatgttgccacatataatagtctgatacatggatattattcattaggacagtgcgaagaggtggatcggattttcaaggagatgactacaaatggtgttcaaccagatattgtaacttacaatatacagatggattatctttgcaagaatggaagatgcgcagaagctaggaagatttttgattctatgatcagtttgggccaaaaacctactgttactacctacaacattctgcttcatgggtatgctatggaaagatcgtttcatgatatgaattgtctcattgagttgatggatgataatggtatttcaccagatcattatggctacaacatactcatatctgcttatgctaaagaaaaaatggttgatgatgtattgcatatatttacaaaaatgcggcagcaaggattgaaccctgatgttgcgaactatggagcggtaataaacttgctttctagtattggccgaatggatgatgctatgtcccaatacaatcaaatgataaatgaaggattactccctggtatcatacttttcagccaacttattagtggtttctgttcttgtggcaaatgggagaaggttcatgaactattttctgagatgttggatcgcggcatctgtcccaacacagtgttcttcaacacaattatcgaccgcctttgcaaaaacggaagggttatggaagcccaagatctcttcgacctgatggtacacatgggtgtgaagcctgatgtgtgtaattataacacattgataggtggatacttgttcattggtaagatggatgaagtgagcaagttacttgacaatatgtgctcaattggcttgaacccaaatgttttcacctatggcatactgatcgatggttactctaagaatggaagtataggtgatgcattggttgtttttagggaaatgttggaagggaaggttaagccttctattatcagttttaatattatgattggtgcgttgcttaaatgtggcaggaaggaagaagccaaagatttgtttgatggtatctgggccaacgtattagtgcctgatgttgttacctatagattaatgatacacaaacttatagaagaaggttctctacaagagtctgatgatctatttgtttctatggagaaggatggctgtgctgccgactcccgtatgctaaatgccatagttagaaggttacttcagaaaggggagatgccaagagctgggacttatctgtctaaaattgatgagaggaggttcacccttgaagcttccactgctagcttgttgactgcacttgtgtcaggggggaaaggccaggaatataaagagttactccccaaaaaataccaatcttttctggaacagggcactgat

SEQ ID NO: 2018 - DNA, 2142 bp, Triticum aestivum
atgagccgccggcttgtccccgtcggtagacgcatcttggagaggaaaattgaagaacggtactgtgccggagacattggcactgacgatgcactcaacctgttctacgaattgatccaggttgctcggccttcctcgatccgtgccattaactgcctcctcaccgtggtccgccgtgattgccctgcgctcggcgtttccctcttcaaccgtgttgcaagagccaaggtgcctccacacaatatcacctatggcattctagtcgactgctgctgccgtgctggccgcttggaccttggacacgctgccatgggacacgtcattaagttgggatttgcagcacaagctgtcgtcaatttcagccacctactcaaggccatctgtgcggagaagaagaccagctatgcaatggacatcgtactccgagtaatccccatgtttaactgcgtgccggatgtcttctcctacagcattcttttcaagggtctttgcaacgaaaggagaagccaagaggctcttgagctgattcacatcatggtacagcatggaggtagctgccaacctaatgtggtgtcctatagcaccgtaattgatggcttgttgaaagagggtgagatgaacaaggcttacagtctattttgtgaaatgttacagaggggaatttcgccgaatgttgtgacctgtagttcaattatctctggcatgtgcaagcttcatgcaatggacaaggctgaggaggttcttcaacagatgcttgatagaggaattctgccaaatagtaccacatataatggcctgatacatgggtattattcactagaacagtgcgaagaggtgggtcggattttcaaggaaatgtctagaaatggtgttcaaccaaatattgtaacttacaatatacagatggattatctttgcaagagcggaagatgcgcagaagctaggaagatttttgattctatggtcagtttgggccaaaaaccagatgttactacctacggcattctgcttcatgggtatgctatggaacgatcttttcatgatattcattgtctcattgatttgatggtcggaaatggtctgtcaccaaataactatatctacagcatactcatatctgcatgtgctaaagaaaaaatggttgatgaggcaatgcatatatttacaaaaatgcggcagcaaggatttaaccctgatgtagtgagctatggaatggtgatagacttgctttccagtattggccgaatggatgatgctatgtcccagttcaatcaaatgataaccgaagggttagctcctgatatcatagttttcaacccccttattagtggtttctgttcttgtggcaaatgggagaaggttcatgaactattttctgagatgttggatcgcagcatctgtcccgacagagtgttcttcaacactgttatggatcacctttgcaaaagtgaaagggttatggaagcccaagatgtgcttgacctgatgatacatatgggtgtgaagcctgttgttcgtgattacaacagactgatacatggatattttttagttggtaagatggatgaagggaggaagttacttgacaatatgtgctccattggcttgaaaccgaatgttgtcacctataacatactgatagatggttactctaagaatggaaggatagatgatgcattggttgttttcagggaaacgttggacaatgttaaggtttctgttatcacttttactattatgatcggtgcgttgcttaaatgtggcagaaaggaagaagccaaagacatgtttgatggtatctgggccaacggattagtgcctgacgttgttacatatagcttaatgatacaaaaacttatagaagaaggttctctacaagagtctgatgatctattcatttctatggagaagaatggatgtgctgccgattcccgtttgctaaacgctatagttagaagcttacttcagaaaggggagattcttagggctgggacttatctgtctaaaattgatgagaggagcttcacccttgaagcttccacagctagtttgttgactgcacttgcttcaggggggaaaggccaggaatataaggagttactccctgaaaaataccactcttttctggaacagggcacggat

SEQ ID NO: 2019 - DNA, 2142 bp, Triticum aestivum; identical to SEQ ID NO: 2018

SEQ ID NO: 2020 - DNA, 2172 bp, Triticum aestivum
atgggtttgggaaggcaaaacccgatgggtttcgtccccgttgccatctggagccgcactagcccgtgctccgccctcagctgcctgcagcgatggccccggccttgccgtcaccctcttcaaccgcatgtgccgaggcgctggtgcactcgtgtggtctcgcccacgtgttgtacctattccatcctcatggactgctgctgccgcgcagaccgcccggacttggtggttgccttcttcggccacctcctcaggctggggctgcgcctgaatgtcatctccttcaacaacctcctcaaggggctctgccaggccaagcgctcaaatgaggcggtggacttgctgctccaccggacacctgaactggactctgtgcctaatgtcttctcgtacggcatcgtaatcaacggctgttttaaacaaggtgaagtagacaaagcgtgcaatctcttccatgagatgatccaactaggagttcaacctaatgtggtgatctacacctcaattatcgatgcactaagcaagtgcggagccatggataaggcagaagtggtccttcagcaaatggttgatcaaggcattgaacccaacatcaggacatatactagcctggtacatggatattccgcttcgggtcagtggaaggcggcagttagagtattcaaggaaatggtaagtgttggtattctaccaaatgctttcactttgaactcatttatggattcactttgcaagcatagaaggacaaaggaagctagagttatttttgactccatggctgcaaagggccaaaaacctaatatcgtctcctactctactatgcttaacgggtatgcgaaagaaggatgcttcgatgatatgacttgtttcttgaatttgatgctacagaatggtgttgtacctgatcaccatgttttcaacatattgattaatgcatgtgctaaacgtggactgatggatgaggctatgcacatgtttgaagtaatgaggcaacaaggagtaaacccagatgtatttggctatcaaatcataatggattcactttgcaaaaagggtaagatggatgctgctctggagaaatttaatcagatggtcaatgaaggagtttcacctaacaaagctgtttaccaatgcctggttctgggttcttgctctcatgatcattttctgaaagccaaggaattgatttctgaagcagttaatagaggtctgtgttctaacagtgcgttcttctatcctgtaataaacgacctgtgcaaagaaggaaaggtgaaggaggcacaggatatgtttgacttcattgtaggtattggtcagcggcctgatgtgattatgtacaattcactgatggatggatattgccttgttggcaaagtggaggaagcactgagagtacttgatgctatgaagtctgctggcctccaacctactgctgttacgtatgatatacttcttaatggctactgtaaaattggaaggattgccgctggattgagtcttttcatggaaatgtcactcagcggggttaagcccactactattatgtacaacattatacttgatgggctgtttcgctccgggagaacagattctgcaaaggaaaaattccgtacgatgagcgaaagtggcataccagtgggcattggcacatacaacatagttcttagtggactttgtaaaaataattgcactggtgaagcaatagagctgttcaagaaactacgtgcaatgaatgtgaagattgatgtcaaaacactcactatcatgatttctgcaatgtttaaaagtaggagaattgaagaagccaaggagttgtttgctactatatcagccatcgggttggtgccttctgttgtgacttacagtgtaatgatgacgaatttcataaaagaagggtcgctggcagaggctgatgatatgtttttagcaatggagaaggctagctgtgctcccaactccatgctgctaaatcaagtggtcagggcgttgctgaaaaaaggtgcagttgtgaaggctgcaacttatctcgctaaacttgatgctaaacagctgtcagttgaagcctcaatgatttcgttaatagtatttctcttctcaggggaagggaaactaagggagcacgtagagttgcttccagtaaagtaccagcctcctgagagttcggctgacaat

SEQ ID NO: 2021 - DNA, 2145 bp, Triticum aestivum
atgagccgccgcgtcgtccccgtcggcagacgcatcttggagcagaacatcaaggctcggtaccacgccggagacattggcaccgaggacgcactccacctgtttgacgaattgctccaggatgctgggcgctcctcgatccatgccatcaactgcctcctcaccgttgtcggccgtgattgccctgcgctcggcgtctccctcttcaaccgcgtcgcaaggtccaaggtggcgcccagcagtatcacctatgccattctggtcgactgctgctgccgcgctggccgccaggaccttggacacactgccatgggacacgtcatcaagatggggtttcttgcagatgccattatcactttcagccacctgctaaaggccatctgtgcggagaacaagaccagctacgcaatggacatcgtactccggataatgcccgagtttaactgcatgccaaacattttctcctacaacattcttttcaagggtctctgcaatgagaagagaagccaagaggctcttgagctgattcaaattatggttgaggatggaggttgctgccgacctgatgtggtgacctatagcactgtaattgatggcttgttgaaagagggtgaggtaggcaaggcttacagcctattttgtgaaatgctgcgtcagggggtatcgccggatattgtgacctgtagttcgattatctctggcatgtgcaagcttcatgcaatggacaaggctgacgaggttcttcaacagatgcttgatagaagaattctgccagatgttgccacatataatagtctggtacatggatattattcattaggacagtgcgaagaggtggatcgggttctcaaggaaatgtctagaaatggtgttcaaccaaatattgtaacttacaatatacagatggattatctttgcaagagcggaaggtgcgcagaagctaggaaaatatttgattttatgatcggtttgggccaaaaaccagatgttactacctacagtgttctgcttcatgggtatgccatggaaaaatcttttcatgagatgcattgtctcattgatttgatggtgggaaatggtatctcaccagatcatcatgtctacaacatactcatatctgcatatgctaaagaagaaatggttggtgaggtattgcatatatttacaaaaatgcggcagcaaggattgaaccctaatgttgtgaactatggagcggtaataaacttgctttctagtattggccgaatggatgatgctatgtcccaattcagtcaaatgataactgaagggttagctcctgatgtcatagttttcaactcccttattagtggtttctgttcttgtggcaaatgggagaaggttcatgaactattttctgagatgtttgatcgcggcatctgtcccgacacagtgttcttcaacactgttatggatcacctttgcaaaaatggaagggttatggaagcccaagatgtgttcgacctgatggtacacatgggtgtgaagccttttgtccgtgattacaacacactgatacatggatactgtttagttggtaagatggatgaagggaggaagttacttgacaatatgttctcaattggctcgaaaccggatgatttcacctatagcatactgattgatggttactctaagaagggaaggatagatgatgcattgattgttatcaaggaaatgttggacgggaaggttaagccttctattatcacttttaatattatgattggtgcgttgcttaaaggtggcagaaaggaagaagccaaagatttgtttgatggtatctgggccaaaggattagtgcccgatgttgttacatatagcttaatgatacaaaaacttatagaagaaggttctctacaagagtctgatgatctattcctttctatggagaagaatggatgtgctgccgactcccggatgctaaatgctatagttagaagcttacttcagaaaggggaggtgccgagggctgggacttatctgtctaaaattgatgagaggaggttcacccctgaagcttccactgctagcttgttgactgcacttgtgtcaggggggaaaggccaggaatataaggagttactccctgaaaaatatcactcttttctggaacagggcactggc

SEQ ID NO: 2022 - DNA, 2145 bp, Triticum aestivum; identical to SEQ ID NO: 2021

SEQ ID NO: 2023 - DNA, 2145 bp, Triticum aestivum
atgaaccgccgcgtcgtccccgtcggcagacgcatcttggagcagaacatcaaggctcggtaccacgccggagacattggcaccgaggacgcactccacctgtttgacgaattgctccaggatgctgggcgctcctcgatccatgccatcaactgcctcctcaccgttgtcggccgtgattgccctgcgctcggcgtctccctcttcaaccgcgtcgcaaggtccaaggtggcgcccagcagtatcacctatgccattctggtcgactgctgctgccgcgctggccgccaggaccttggacacactgccatgggacacgtcatcaagatggggtttcttgcagatgccattatcactttcagccacctgctaaaggccatctgtgcggagaacaagaccagctacgcaatggacatcgtactccggataatgcccgagtttaactgcatgccaaacattttctcctacaacattcttttcaagggtctctgcaacgagaagagaagccaagaggctcttgagctgattcaaattatggttgaggatggaggttgctgccgacctgatgtggtgacctatagcactgtaattgatggcttgttgaaagagggtgaggtaggcaaggcttacagcctattttgtgaaatgctgcgtcagggggtatcgccggatgttgtgacctgtagttcgattatctctggcatgtgcaagcttcatgcaatggacaaggctgaggaggttcttcaacagatgcttgatagaagaattctgccagatgttgccacatataatagtctggtacatggatattattcattaggacagtgcgaagaggtggatcgggttctcaaggaaatgtctagaaatggtgttcaaccaaatattgtaacttacaatatacagatggattatctttgcaagagcggaaggtgcgcagaagctaggaaaatatttgattttatgatcggtttgggccaaaaaccagatgttactacctacagtgttctgcttcatgggtatgccatggaaaaatcttttcatgagatgcattgtctcattgatttgatggtgggaaatggtatctcaccagatcatcatgtctacaacatactcatatctgcatatgctaaagaagaaatggttggtgaggtattgcatatatttacaaaaatgcggcagcaaggattgaaccctaatgttgtgaactatggagcggtaataaacttgctttctagtattggccgaatggatgatgctatgtcccaattcagtcaaatgataactgaagggttagctcctgatgtcatagttttcaactcccttattagtggtttctgttcttgtggcaaatgggagaaggttcatgaactattttctgagatgtttgatcgcagcatctgtcccgacacagtgttcttcaacactgttatggatcacctttgcaaaaatggaagggttatggaagcccaagatgtgttcgacctgatggtacacatgggtgtgaagccttttgtccgtgattacaacatactgatacatggatactgtttagttggtaagatggatgaagggaggaagttacttgacaatatgttctcaattggctcgaaaccggatgatttcacctatagcatactgattgatggttactctaagaagggaaggatagatgatgcattgattgttatcaaggaaatgttggacgggaaggttaagccttctattatcacttttaatattatgattggtgcgttgcttaaaggtggcagaaaggaagaagccaaagatttgtttgatggtatctgggccaaaggattagtgcccgatgttgttacatatagcttaatgatacaaaaacttatagaagaaggttctctacaagagtctgatgatctattcctttctatggagaagaatggatgtgctgccgactcccggatgctaaatgctatagttagaatcttacttcagaaaggggaggtgccgagggctgggacttatctgtctaaaattgatgagaggaggttcacccctgaagcttccactgctagcttgttgactgcacttgtgtcaggggggaaaggccaggaatataaggagttactccctgaaaaatatcactcttttctggaacagggcactggc

SEQ ID NO: 2024 - DNA, 2145 bp, Triticum aestivum
atgagccgccgctttgtccccgtcagcagacgcatcttagagcagaacatcaaggctccgtaccacgccggagacattggcaccgaggacgcactccacctgtttgacgaattgctccaggttgctgggcgctcctcgatccatgccatcaactgcctcctcaccgttgtctgccatgattgccctgcgctcggcgtctccctcttcaaccgcgtcgcaaggtccaaggtggcgccctgcagtatcacctatgccattctggtcgactgctgctgccgcgctggccgcctggaccttggacacactgccatgggacacatcatcaagatgggatttactgcagatgctatgatcactttcagccacctactcaaggccatatgtgcagagaacaagaccagctatgcaatggacatcgtactccgaataatgcccatgtttaactgcgtacccaacaatttctcctacaacattcttttcaagggtctttgcaacgaaaggagaagccaagaggctcttgagctgattcacatgatggtacagcatggaggtagctgccaacctaatgtggtgtcctataacaccgtagttgatggcctgttgaaagagggtgaggtgggcaaagcttacaccctattttctgaaatgctgcgtcaggggatatcaccggatgttgtgacctgtcgttccatcatctctggcatgtgcaaggttcatgcaatggacaaggctgaggaggttcttcaacagatgcttgatagaagaattctgccagatgttgccacatataatagtctgatacatggatattatttattaggacagtgcgaagaggtggatcggattttcaaggaaatgtctagaaatggtgttcaaccaaatgttgtaacttacactatacagatggattatctttgcaagagcggaagatgcgcagaagctaggaagatttttgattctatgatcagtttgggccaaaaaccggatgtttatacctacagtattctactgcatgggtatgctatggaaaaatcttttcatgatatgcattgtctcattgatttgatggtagaaaatggtattgcaccagatcatcatgtctacaacatactcatatctgcatgtgctcaagaagaaatggttagtgacgtaatgcatatatttacaaaaatgcggcagcaaggattgaaccctaatgtagcgaactatggagtggttgtaaacttgctttgcagcatgggccgaatggatgatgctatgtaccaatacaatcaaatgataaccgaaggattagatcctgatatcatagttttcagcacccttataagtggtttttgttcttgtggcgcatgggagagggttcatgaaatattttctgaaatgttgaatcgtggcatctatcctgataccgtgttcttcaacataattatggaccacctttgcaaagagggaagggttatggaagcccaggatatcttcgacctgatggtacacatgggtgtgaagccttttgtccgtgattacaacacactgatacatggatactgtttagttggtaagatggatgaagggaggaagttacttgacaatatgtgctcaattggcttgaaaccggatgatttcacctatagcatactgattgatggttactctatgaagggaaggatagatgatgcattgattgttgtcagggaattgttggacgggaaggttggaccttctattatcacttttaatattatgattgttgcgttgcttaaaggtgggagaaaggaagaagccaaagatttgtttgatggtatctgggccaaaggattagtgcccgatgttgttacatatagcttaatgatacaaaaacttatagaagaaggttctctacaagagtctgatgatctattcctttctatggagaagaatggatgtgctgccgattcccgcatgctaaatgctatagttagaagcttacttcagaaaggggatgtgcccagggctgggacttatctgtctaaagttgatgagaggagcttcacccttgaaggttccacagctaccttgttgactgcacttgcttcagggaggaaaggccaggaatataaggggttactccctgaaaaataccactcttttctggaacaggacactggt

SEQ ID NO: 2025 - DNA, 2145 bp, Triticum aestivum; identical to SEQ ID NO: 2024

SEQ ID NO: 2026 - DNA, 1800 bp, Triticum aestivum
atggcaggtcccaaaagccacctactcaaggccatatgtgcagagaacaagaccagctatgcaatggacatcgtactccgaataatgcccatgtttaactgcgtacccaacaatttctcctacaacattcttttcaagggtctttgcaacgaaaggagaagccaagaggctcttgagctgattcacatgatggtacagcatggaggtagctgccaacctaatgtggtgtcctataacaccgtagttgatggcctgttgaaagagggtgaggtgggcaaagcttacaccctattttctgaaatgctgcgtcaggggatatcaccggatgttgtgacctgtcgttccatcatctctggcatgtgcaaggttcatgcaatggacaaggctgaggaggttcttcaacagatgcttgatagaagaattctgccagatgttgccacatataatagtctgatacatggatattatttattaggacagtgcgaagaggtggatcggattttcaaggaaatgtctagaaatggtgttcaaccaaatgttgtaacttacactatacggatggattatctttgcaagagcggaagatgcgcagaagctaggaagatttttgattctatgatcagtttgggccaaaaaccggatgtttatacctacagtattctactgcatgggtatgctatggaaaaatcttttcatgatatgcattgtctcattgatttgatggtagaaaatggtattgcaccagatcatcatgtctacaacatactcatatctgcatgtgctcaagaagaaatggttagtgacgtaatgcatatatttacaaaaatgcggcagcaaggattgaaccctaatgtagcgaactatggagtggttgtaaacttgctttgcagcatgggccgaatggatgatgctatgtaccaatacaatcaaatgataaccgaaggattagatcctgatatcatagttttcagcacccttataagtggtttttgttcttgtggcgcatgggagagggttcatgaaatattttctgaaatgttgaatcgtggcatctatcctgataccgtgttcttcaacataattatggaccacctttgcaaagagggaagggttatggaagcccaggatatcttcgacctgatggtacacatgggtgtgaagccttttgtccgtgattacaacacactgatacatggatactgtttagttggtaagatggacgaagggaggaagttacttgacaatatgtgctcaattggcttgaaaccggatgatttcacctatagcatactgattgatggttactctatgaagggaaggatagatgatgcattgattgttgtcagggaattgttggacgggaaggttggaccttctattatcacttttaatattatgattgttgcgttgcttaaaggtgggagaaaggaagaagccaaagatttgtttgatggtatctgggccaaaggattagtgcccgatgttgttacatatagcttaatgatacaaaaacttatagaagaaggttctctacaagagtctgatgatctattcctttctatggagaagaatggatgtgctgccgattcccgcatgctaaatgctatagttagaagcttacttcagaaaggggatgtgcccagggctgggacttatctgtctaaagttgatgagaggagcttcacccttgaaggttccacagctaccttgttgactgcacttgcttcagggaggaaaggccaggaatataaggggttactccctgaaaaataccactcttttctggaacaggacactggt

SEQ ID NO: 2027 - DNA, 2145 bp, Triticum aestivum; identical to SEQ ID NO: 2024

SEQ ID NO: 2028 - DNA, 2145 bp, Triticum aestivum; identical to SEQ ID NO: 2024

SEQ ID NO: 2029 - DNA, 2145 bp, Triticum aestivum; identical to SEQ ID NO: 2024

SEQ ID NO: 2030 - DNA, 2145 bp, Triticum aestivum; identical to SEQ ID NO: 2024

SEQ ID NO: 2031 - DNA, 2145 bp, Triticum aestivum
atgagccgccgctttgtccccgtcggcagacgcatcttagagcagaacatcaaggctcggtaccacgccggagacattggcaccgaggacgcactccacctgtttgacgaattgctccaggttgctgggcgctcctcgatccatgccatcaactgcctcctcaccgttgtcggccgtgattgccctgcgctcggcgtctccctcttcaaccgcgtcgcaagggccaaggtggcaccctgcagtatcacctatgccattctggtcgactgctgctgccgcactggccgccaggaccttggtttcgctgccatgggacacgtcatcaagatgggatttactgcagatgctatgatcactttcagccacctactaaaggccatctgtgcggagaacaagaccagctatgcaatggacatcgtactccgaataatgcccatgtttaactgcataccggatgtcttctcttacaacattcttttcaagggtctctgcaacgagaagagaagccaagaggctctcgagctgattcaggtgatggttgagcatggaggtcgctgccaacctgatgtggtgtcctatagcaccgtaattgatggcttgttgaaagagggtttggtgggcaaggtttacatcctattttgtgaaatgatacagagaggaatttcgccgaatgctgtgacctataactcaatcatctctggcatgtgcaaggttcatgcgatggacaaggctgagcaggttcttcaacagatgcctgatagaggaattctgccaaatgttgccacgtatactagtctaatacatggatatttttcattaggacagtgcaaagaggtggatcggattttcaaagaaatgtctagaaatggtgttcaaccaaatgttgtaacttataatatacagatggattatctttgcaagaatggaagatgcgcagaagctaggaagatttttgattccatggtcagtttgggccaaaaaccgactgttactacctacagcattttgcttcatgggtatgctctggaacgatcttttcatgagatacattgtctcattgatttgatggtgggaaatggtattgcgccaaatcattttctctacaacatactcatatctgcatatgctaaagaagaaatgattggtgaagtaatgcatatatttaaaaaaatgcggcagcatggattgaaccctaatgtagcgacctatggagcggtagtaaacttactttccaagattggccgaatggatgatgctatgtcccaattcaatcaaatgataactgaagggttagctcctgatatcatagttttcaccctccttattagtggtttctgttcttgtggcaaatgggagaaggttgatgaactattttctgagatgttggatcgcggcatctgtcccaacacagtgttcttcaacataattatggactgcctctgcaaaaatgaaagggttatggaagcccaagatctcttcgacctgatggtacacatgggtgtgaagcctgatgtgtgtacttataacacactgataggtggatacttgttcattggtaagatggatgaagtgaggaagttacttgacaatatggtctcaattggcttgaaaccaaatgttatcacatatagcatactgattgatggttactctaagaatggaagcatagatgatgcattggttgtttccagggaaatgttggccgggaaggttaagccttgtgttatcacttttaatattatgattggtgcattgcttaaatgtggcaggaaggcagaagccaaagatttgtttgacggtatctgggccaacggattagtgcccgatgttattacatatagcttaatgatacaaaaacttattgaagaaggttctctacaagagtctgatgatctattcctttctatggagaagaatggatgtgttgccgactcccatatgctaaatgctatagttagaagcttacttcagaaaggggaggtgccaagggctgggacttatctgtctaaaattgatgagaggaggttcacctttgaagcttccacagctagcttgttggttgcacttgcgtcagggcggaaaagccaggaatataaggagttactccccgaaaaataccactattttctggaagagggcactgat

SEQ ID NO: 2032 - DNA, 1245 bp, Triticum aestivum
atgagccgccgctttccccctggagctatgagcagacgcatcttggagcggaaaattcaagaccggtaccatgccggacacattggcactcacaacgcactcaacctgttcgacgaattgatccaggttgctgggccttcctcggtccgcgccattaactgcctcctcaccgtcgtcggccgtgattgccctgtgctgggcgtctccctcttcaaccgtgttgcaagagccaaggtgcctccccacaatatcacctatagcattctagtcgactgctgctgccgtgctggctgcttggaccttggacacgctgccatgggacacgttattaagctgggatttacagaagctatcgtcaatttcagccacctactcaaggccatctgtgcggagaagaagaccagctatgcaatggacattgtactccgaataatgcccatgtttaactgtgtaccaaatattttctcctacagcattgttttcaagggtctctgcaacgagaagagaagccaagaggctcttgagctgattcaaattatggttgaggatggaggttgctgccgacctgatgtggtgacctatagcactgtaattgatggcttgttgaaagagggtgaggtggaccaagcttacaacctattttctgaaatgctgcgtcagggggtatcgccgaatgttgtgacctgtagttcaatcatctctggcatgtgcaaagctcaatcagtggacaaggctaaggaggttcttcaacagatgtttgagagaggaattctgccaaatattaccacatataatagtctgatacaaggctattattcattaggacggtgcaaagaggtggatcagattttcaaggagatgactataaatggtgtccaaccagatattataacttacaatatacagatggattatctttgcaagagcggtcaatgtgcagaagctaggaagatttttgattctatgatcagtttgggccaaaacccgactgctactacctacagtattctgcttcatgggtatgctatggaaaaatcttttcatgatatgcattgtcttattgatttgatggtagaaaatggcatttcacctgatcattatgtctacaacatactcatatctgcatacgctaaagaagaaatggttggtgaggtaatgcatatatttacaaaaatgcggcagcaaggattgaaccctgatgcagtgagctacggaacagtaatagacttactttccaggattggc

SEQ ID NO: 2033 - DNA, 1245 bp, Triticum aestivum; identical to SEQ ID NO: 2032

SEQ ID NO: 2034 - DNA, 2151 bp, Triticum aestivum
atgagccgccgctttccccctggagctatgagcagacgcatcttggagcggaaaattcaagaccggtaccatgccggacacattggcactcacgacgcactcaacctgttcgacgaattgatccaggttgctgggccttcctcggtccgcgccattaactgcctcctcaccgtcgtcggccgtgattgccctgcgctgggcgtctccctcttcaaccgtgttgcaagagccaaggtgcctccccacaatatcacctatagcattctagtcgactgctgctgccgtgctggccgcttggaccttggacacgctgccatgggacacgttattaagctgggatttacagaagaagctatcgtcaatttcagccacctactcaaggccatctgtgcggagaagaagaccagctatgcaatggacattgtactccgaataatgcccatgtttaactgtgtaccaaatattttctcctacagcattgttttcaagggtctctgcaacgagaagagaagccaagaggctcttgagctgattcaaattatggttgaggatggaggttgctgccgacctgatgtggtgacctatagcactgtaattgatggcttgttgaaagagggtgaggtggaccaagcttacaacctattttctgaaatgctgcgtcagggggtatcgccgaatgttgtgacctgtagttcaatcatctctggcatgtgcaaagctcaatcagtggacaaggctaaggaggttcttcaacagatgtttgagagaggaattctgccaaatattaccacatataatagtctgatacaaggctattattcattaggacggtgcaaagaggtggatcagattttcaaggagatgactataaatggtgtccaaccagatattataacttacaatatacagatggattatctttgcaagagcggtcaatgtgcagaagctaggaagatttttgattctatgatcagtttgggccaaaacccgactgctactacctacagtattctgcttcatgggtatgctatggaaaaatcttttcatgatatgcattgtcttattgatttgatggtagaaaatggcatttcacctgatcattatgtctacaacatactcatatctgcatacgctaaagaagaaatggttggtgaggtaatgcatatatttacaaaaatgcggcagcaaggattgaaccctgatgcagtgagctacggaacagtaatagacttactttccaggattggccgaatggatgatgctatgtccctattcaatcaaatgataactgaaggattagctcctggtaccatagttttcaaccaccttattagtggtttttgtacttgtggcaaatgggagaaggttcatgaactattttctgaaatgttggatcgcggcatctgtccagacacagtgttcttcaacacagttatggatcgcctttgcaaaaatggaagggttacggaagcccaggatctcttcgacctgatggtacacatgggtgtgaagcctgatgtgtgtacttataacacactgatgggtggatacttgttcattggtaagatggatgaagtgagcaagttactagaaaatatgtgctcaattggcttgaaactggatgttgtcacctatagcatactgatagatggttactctaagaatggaaggatagatgatgcattggttgttttcagggaaatgatggacgggaaggttaagccttctgttatcacttttaatattatgattggtgcattgcttaaaggtggcaggaaggaagaagccacagatttgtttaatggtatctggcccaaaggattagtgcccgatgttgttacatatagcttaatgatacaaaaacttatagaagaaggttctctacaagagtctgatgatctattcctttctatggagaagaatggatgtgctgccgactcccgtatgctaaatgctatagttagaagcttacttcagaaaggggaggtgcccagggctgggtcttacctgtccaaaattgatgagaggagcttcacccttgaagcttccacagctagcttggtgacagcacttgcgtcaggggggaaaggccaagaatataaggagttactccccgaaaaataccactcttttctggaacacggcacggat

SEQ ID NO: 2035 - DNA, 1245 bp, Triticum aestivum; identical to SEQ ID NO: 2032

SEQ ID NO: 2036 - DNA, 1842 bp, Triticum aestivum
atgggacacgttattaagctgggatttacagaagaagctatcgtcaatttcagccacctactcaaggccatctgtgcggagaagaagaccagctatgcaatggacattgtactccgaataatgcccatgtttaactgtgtaccaaatattttctcctacagcattgttttcaagggtctctgcaacgagaagagaagccaagaggctcttgagctgattcaaattatggttgaggatggaggttgctgccgacctgatgtggtgacctatagcactgtaattgatggcttgttgaaagagggtgaggtggaccaagcttacaacctattttctgaaatgctgcgtcagggggtatcgccgaatgttgtgacctgtagttcaatcatctctggcatgtgcaaagctcaatcagtggacaaggctaaggaggttcttcaacagatgtttgagagaggaattctgccaaatattaccacatataatagtctgatacaaggctattattcattaggacggtgcaaagaggtggatcagattttcaaggagatgactataaatggtgtccaaccagatattataacttacaatatacagatggattatctttgcaagagcggtcaatgtgcagaagctaggaagatttttgattctatgatcagtttgggccaaaacccgactgctactacctacagtattctgcttcatgggtatgctatggaaaaatcttttcatgatatgcattgtcttattgatttgatggtagaaaatggcatttcacctgatcattatgtctacaacatactcatatctgcatacgctaaagaagaaatggttggtgaggtaatgcatatatttacaaaaatgcggcagcaaggattgaaccctgatgcagtgagctacggaacagtaatagacttactttccaggattggccgaatggatgatgctatgtccctattcaatcaaatgataactgaaggattagctcctggtaccatagttttcaaccaccttattagtggtttttgtacttgtggcaaatgggagaaggttcatgaactattttctgaaatgttggatcgcggcatctgtccagacacagtgttcttcaacacagttatggatcgcctttgcaaaaatggaagggttacggaagcccaggatctctttgacctgatggtacacatgggtgtgaagcctgacgtgtgtacttataacacactgatgggtggatacttgttcgttggtaagatggatgaagtgagcaagttacttgacaatatggtctcaattggcatggaaccagatgttatcacatatagcatactgattgatggttactctaagaatggaaggatagatgatgcattggttgttttcagggaaatgttggacacgaagggtaagccgtctgttatcagttttaatattatgattggtgcattgcttaaatgtggtaggaaggaagaagccaaagatttgtttgatggtatctgggccaatgggttagtgcctgacgttattacatatagcttaatgatacaaaaacttattgaagaaggttctctacaagagtctgatgatctattcctttctacggagaagaatggatgtgctgccgactcccgtaggctaaatgctatagttagaagcttacttcagaaaggggagattcctagggctgggacttatctgtctaaaattgatgagaggggcttcacccttgaagcttccacagctagcttgttgactgcacttgcttcagggggaaaaggccaggaatacaaggagttactccctgaaaaataccactcttttctggaacagggcactttgaacttc

SEQ ID NO: 2037 - DNA, 2145 bp, Triticum aestivum
atgagccgccgctttgtccccgtcgacagacgcatcttggagaggaacatcaaggatcggtaccatgccggatgcattggcaccgaggacgcactccacctgttcgacgaattgctccaggttgctgggccttcctcgatccctgccatcaactgcctcctcactgttgttggccgtgattgccccgcgctcggcgtctccctcttcaaccatgttgcaagagccaaggtgcctccccacaatatcacctatggcattctagtcgactgctgctgccgtgctggccgcctggaccttggacacgctgccatgggacacgtcattaagttgggatttacagcagaagctatcatcaatttcagccacctactcaaggccatctgcgccgagaagaagaccagttatgcaatggacatcgtactccggataatgcctgagtttaactgcataccaaacattttctcctataacattcttttcaagggtctctgcaacgagaagagaagccaagaggctctcgagctgattcaaattatggttgaggatggaggttgctgccgacctgatgtggtgacctatagcactgtaattgatggcttgttgaaagaggatgaggtggaccaagcttacagcctattttctgaaatgctgcgtcagggggtatcaccgaatgttgtgacctgtaattcaatcatctctggcatgtgcaagcttcacgcgatggacaaggctgaggaggttcttcaacagatgcttgatagacgaattctgccagatgttaccacatatactagtttaatacatggatattattcattaggacagtgcgaggaggtggatcgggttttcatagaaatgtctagaaatggtgttcaaccaaatatcataacttatagtatacagatggattatctttgcaagaatggaagatgcacagaagctaggaagaattttgatttcatgatcagtttgggccagaaaccgactgttactacctacaacattatgcttcatgggtatgctatggaaagatcttttcatgatatgaattgtctcattgatttgatggatgataatggtatttcaccagatcattatggatacaacatacttatatttgcatatgctgaagaaaaaatggttgatgaagtaatgcatatatttacaaaaatgcggcagcaaggattgaaccctgatgcagtgagctatggaacagtaatagacttactttccaggattgaccgaatggatgatgctatgtcccagttcaatcaaatgataactgaagggttagttcctgatatcgtagtttttaaccctcttattaggggtttctgttcttgtggcaaatgggagaaggttgatgaactattttctgagatgttggatcgcggcatctgtcccaacatagtgttcttcaccacaattatggaccgcctttgcaaaaatggaagggttatggaagcccaagatctcttcgacctgatggtacacatgggtgtgaagcctgatgtgtgtacttataacatactgataggtggatacttgttcattggtaagatggatgaagtgagcaagttacttgacaatatggtctcaattggcatggaaccagatgttatcacctataacatactgattgatggttactctaagaatggaaggatagatgatgcatttgttgttttcagagaaatgttggccgggaaggttaagccttgcattatcacttttaatattatgcttggtgcgttgcttaaaggtggcaggaaggaagaggctaaagatttgtttgatggtatctgggctaaagggttagtgcccaccgttgttacatatagcttaatgatacaaaaacttatagaagaaggttctctacaagagtctgatgatctatttgtttctatggagaagaatggatgtgctgccgactcccatataataaatgctatagttagaagcttatttcggaaaggggaggtgcccagggctgggacttatctgtctaaaattgatgagaggagcttcacccttgaagcttccacagctatcttgttgactgcacttgcttcaggggggaaaggccaggaatataaagagttactccctgagaagtaccactcttttctggaacagggcactgat

SEQ ID NO: 2038 - DNA, 2145 bp, Triticum aestivum; identical to SEQ ID NO: 2037

SEQ ID NO: 2039 - DNA, 2145 bp, Triticum aestivum; identical to SEQ ID NO: 2037

SEQ ID NO: 2040 - DNA, 2145 bp, Triticum aestivum; identical to SEQ ID NO: 2037

SEQ ID NO: 2041 - DNA, 2145 bp, Triticum aestivum; identical to SEQ ID NO: 2037

SEQ ID NO: 2042 - DNA, 2145 bp, Triticum aestivum
atgagccgccgctttgtccccgtcgacagacgcatcttggagaggaacatcaaggatcggtaccatgccggatgcattggcaccgaggacgcactccacctgttcgacgaattgctccaggttgctgggccttcctcgatccctgtcatcaactgcctcctcactgttgttggccatgattgccccgcgctcggcgtctccctcttcaaccatgttgcaagagccaaggtgcctccccacaatatcacctatggcattctagtcgactgctgctgccgtgctggccgcctggaccttggacacgctgccatgggacacgtcattaagttgggatttacagcagaagctatcatcaatttcagccacctactcaaggccatctgcgccgagaagaagaccagttatgcaatggacatcgtactccggataatgcctgagtttaactgcataccaaacattttctcctataacattcttttcaagggtctctgcaacgagaagagaagccaagaggctctcgagctgattcaaattatggttgaggatggaggttgctgccgacctgatgtggtgacctatagcactgtaattgatggcttgttgaaagaggatgaggtggaccaagcttacagcctattttctgaaatgctgcgtcagggggtatcaccgaatgttgtgacctgtaattcaatcatctctggcatgtgcaagcttcacgcgatggacaaggctgaggaggttcttcaacagatgcttgatagacgaattctgccagatgttaccacatatactagtttaatacatggatattattcattaggacagtgcgaggaggtggatcgggttttcatagaaatgtctagaaatggtgttcaaccaaatatcataacttatagtatacagatggattatctttgcaagaatggaagatgcacagaagctaggaagatttttgatttcatgatcagtttgggccagaaaccgactgttactacctacaacattatgcttcatgggtatgctatggaaagatcttttcatgatatgaattgtctcattgatttgatggatgataatggtatttcaccagatcattatggatacaacatacttatatttgcatatgctgaagaaaaaatggttgatgaagtaatgcatatatttacaaaaatgcggcagcaaggattgaaccctgatgcagtgagctatggaacagtaatagacttactttccaggattgaccgaatggatgatgctatgtcccagttcaatcaaatgataactgaagggttagttcctgatatcgtagtttttaaccctcttattaggggtttctgttcttgtggcaaatgggagaaggttgatgaactattttctgagatgttggatcgcggcatctgtcccaacatagtgttcttcaccacaattatggaccgcctttgcaaaaatggaagggttatggaagcccaagatctcttcgacctgatggtacacatgggtgtgaagcctgatgtgtgtacttataacatactgataggtggatacttgttcattggtaagatggatgaagtgagcaagttacttgacaatatggtctcaattggcatggaaccagatgttatcacctataacatactgattgatggttactctaagaatggaaggatagatgatgcatttgttgttttcagagaaatgttggccgggaaggttaagccttgcattatcacttttaatattatgcttggtgcgttgcttaaaggtggcaggaaggaagaggctaaagatttgtttgatggtatctgggctaaagggttagtgcccaccgttgttacatatagcttaatgatacaaaaacttatagaagaaggttctctacaagagtctgatgatctatttgtttctatggagaagaatggatgtgctgccgactcccatataataaatgctatagttagaagcttatttcggaaaggggaggtgcccagggctgggacttatctgtctaaaattgatgagaggagcttcacccttgaagcttccacagctatcttgttgactgcacttgcttcaggggggaaaggccaggaatataaagagttactccctgagaagtaccactcttttctggaacagggcactgat

SEQ ID NO: 2043 - DNA, 2145 bp, Triticum aestivum; identical to SEQ ID NO: 2037

SEQ ID NO: 2044 - DNA, 2139 bp, Triticum aestivum
atgagccgccgctttcccactgtcggcagacgcatcttggagcggaaaattcaagaccggtaccgtgccggacacattggcactgacgacgcactcaacctgttcgacgaattgatccagcttgctgggccttcctcggtccgcgccattaactgcctcctcaccgtggtcggccgtgattgccctgcgctcggcatcttcctcttcaatcgtgttgcaagagccaaggtgcctccccacaatatcacctatggcattctagtcgactgctgctgccgtgctggccgcttggaccttggacacgctgccatgggacacgtcattaagttgggatttgcagcagaagccatcgtcaatttcagccacctactcaaagccatctgcgccgagaagaagaccagctatgcaatggaaatcgtactccgaataatgcccatgtttaactgcgtaccaaacattttctcctacagtattcttttcaagggtctctgcaacgagaaaagaagccaagaggctctcgagctgattcacatcatggttgaccatggaggtagctgccaacctaatgtggtgtcctataacactgtagttgatggcctgttgaaagagggtgaggcaggcaaggcttacagcctattttctgaaatgctacagagggaaattttgccggatgttgtgacctacaactcaatcatctctggcatgtgcaaggttcatgcgatggacaaggctgaggaggttcttagacagatgtttgatagaggaattctcccagatattgccacatatactagtctaatacatggatattattcatcaggacagtgcaaagaggtggaacgggttttcaacgaaatgtctagaaatggtgttcaaccaaatatggtaacttacaatatacagatggattatctttgcaagagcggaagatgcacagaagctaggaagatttttgattctctgatcgatttgggccaaaaactgactgttactacctacagcattctgcttcatgggtatgctctggaacgatctttgcatggtatgcattgtctcattgatttgatggtgggaaatggtatctcaccagatcatcatgtctacaacatactcatatctgtatatgctaaagaaggaatggttggtgaggtaatgcatatatttacaaaaatgcggcagcaaggattgaaccctgatgttgtgaactacggaacggtaataaacttactttgcagcattggccgaatggatgatgctatgttgcaattcagtcaaatgataacggaaggattagctcctaatatcatagttttcaccccccttattagtggtttttgtacgtatggcaaatgggagaaggttcatgaactattttctgaaatgttcgatcgcggcatctatcctgataccttgtttttcaccacagttatggaccgcctttgcaaaaatgaaagggttatggaagcccaagatatctttgacctgatgggacacatgggtgttaagcctgacgtgtgtacttataacacactgataggtggatacttgtttgttggtaagatggatgaagtgaggaaattacttgacaatatggtctcaattggcatggaaccagatgttatcacctatagcagactgatagatggttactctaagaatggaaggatagatgatgcattggttgttttctgggaaatgttggatgggaaggttaagccgtctgttatcacttttaatattattattggtgcgttgcttcaaggtggcaggaaggaagaagccaaagatttgtttgattgtatctgggccaaaggattagtgcctgatgttgttacatatagcttaatgatacaaaaacttatagaagaaggttctctacaagagtctgatgatctattcatttctatggagaagaatggatgtgctgccgactcccgtatgctgaatgctatagttagaagcttacttcagaaagaggagattcttagggctgggacttatctgtctaaaattgatgagaggaggttcacccttgaagcttccactgcgagcttgttgactgcacttgtgtcaggggggaaaggccaggaatataaggagttactcccggaaaattactctgaactgctaatcgaggcc

SEQ ID NO: 2045 - DNA, 2073 bp, Triticum aestivum
atgagccgccgcgccgtccccgctggcagacgcatcttggagcagaacatcaaggcccggtaccgcgctggcaacattggcaccgaggatgcactccacctgtttgacgaattgctcccggttgctcggccctcctcagttcctgccatcaactgcctcctcattgtcgtcggtcgtgattgccctgcactcgccgtctccctcttcaaccgcattgcaagaaccaaggtggcaccccagaatatcacctacggcattctagtcgactgctgctgccttgcgggccgcttggaccttggtttcgctgccatgggccacatcattaagacgggatttgcggcaggatccgttatctctttcagccacctgctcagggccgtctgtgcggagaagaagaccagctacggaatggacatcgtgctccgaattatgcctgagcttaactgcacgccggatgtttactcctacagcattcttttcaagggtctctgcaacgagaagagaagccaagaggctctcgagctgattcacgtgatggttgagcacggaggtagctgccaacctaatctggtctcctacagcaccgtaattgatggcttgttgaaagagggcgaggtgggcaaagcttacagcctattttgtgaaatggtacacagggggatttcgccagatattgtgacctacaactcaatcatctctggcatgtgcaaggtccatgcgatggacaaggctgagaaggttcttcaacaaatgtttgatagagaaattctgccagatactaccacatatactagcctaatacatggatattattcatcaggacaatgcaaagaggtggaacgggttttcgagcacatgtctataaacggtgttcaaccaaatatgataacttacaatatacagatggattatctttgcaagagcggaagatgcgcagaagctaggaagatttttgattctatggtcagtttgggccaaaaaccgtctgttactacctatagtattctgcttcatggttatgctatggaaaaatcatttcatgatatgcattgtctcattgatttgatggtagaaaatggtatctcaccagatcattatgtctacaacatgctcatatctgcatgtcctaaagaagaaatgtttggtgaggtaatgcatatatttacaaaaatgcggcagcaaggattgaaccctaatgttgctaactatggagcggtaataaacttgctttccagtgctggcaaaatggatgatgctatgtgccaattcaatcaaatgataaccgaaggattagctcctgatatcgtaattttcaacacccttattagtggtttttgtacttgtggcaaatgggagaaggttcatgagctattttctgaaatgttgaatcgcggcatctatcctgatatcgtgtccttcaccatacttatggaccgcctttgcaaaagtggaagggttatcgaagcccaagatatgtttgacctgatggtacgcatcggtgttaagcctaacattcatacttatggcacattgatgcatgggtactttttcgttagaaaggtggatgaagtgaggaagttacttggcaatatgctctcaactggcttgaaaccagatgttttcacctataccatattgattgatggttactttaagaatggaatgatagatgacgcatcagctgttttcactgagatgttggaaaagaaagttgagccttctgtcatcacttacagaacaatgcggtatggcctgttaaattctggaaggactgttgctgccactaaactatatctcaggatgattgacagtggaatacacgtggatattgcggcctacaacataattctcagaggcctttgtaaaaataactgtgtcgatggagcgctaagaatgtttcaacacctatcttcaacaaattatccgcttgaggttgggacttacaatattatgattagtgcgttggttaaaggtggcagaaaggaagaagccacagatttgtttgatgatatgttggccaaaggattagtgccggatgctgttatgtatagcttaataaaaaaaggagtagtc

SEQ ID NO: 2046 - DNA, 2073 bp, Triticum aestivum; identical to SEQ ID NO: 2045

SEQ ID NO: 2047 - DNA, 2073 bp, Triticum aestivum; identical to SEQ ID NO: 2045

SEQ ID NO: 2048 - DNA, 2073 bp, Triticum aestivum; identical to SEQ ID NO: 2045

SEQ ID NO: 2049 - DNA, 2073 bp, Triticum aestivum; identical to SEQ ID NO: 2045

SEQ ID NO: 2050 - DNA, 2073 bp, Triticum aestivum; identical to SEQ ID NO: 2045

SEQ ID NO: 2051 - DNA, 1989 bp, Triticum aestivum
atggactgctgctgccgcgcaaaccgccaggatctggcgctcgccttcttcggccgtctcctcaggacgggacttaaggcaggcgtcatagaagtcaacactcttctcaagggactctgccgcgcaaagcgggctgatgaggctctggacattctgcttcacaggatgcctgagcttggctgcgcccccaacgtggtggcatataccacggtcatccacggcttctttaaggaaggccaagtaagcaaggcatgcaatctattccatgaaatggcgctgcagggcgttacacctgatgtggtgacatataactcggttattgatgcgctgtgcaaggccagagccatggacaatgcagagtatttccttcgtcaaatggttgataatggtgtcgtacctaataatgtgacatatagtagcctcatccatggatattcctcttcaggccattggaaggaggcagttagggtattcaaagagatgacaggtcggagggttacaccagatgtgcatacttacaacatgtttatgacctttctttgcaaacatggaagaagcaaagaagctgcaggaatttttgataccatggctatgaagggcctgaaacctgacaacgtttcatatgctattcgccttcatgggtatgccaccgaaggatgcttagttgatatgattaatctcttcaattcaatggaaagagactgtattctacctgactgtcatatcttcaacatactgattaatgcatatgctaaatctgggaagcttgataaggctatgcttatcttcaatgaaatgcagaaacaaggagtgagtccaaatgcagtcacatattcaaccataatacatgcattttgcaaaaagggtaggttggatgatgctgtgataaagtttaatcagatgattgatacaggagtacgacagggcacagctgtttatcgttccctaatccaaggtttttgtacacacggcgatttggtgaaagcaaaggaattgcttactgaaatgatgaacaaaggtatacctcctcctgatattaagttcttccattcaatcatgcagaacctatgcacagaaggaagggtaatagaagcacgggatatccttggcttgatagcacacataggtatgaggcctaatgtttgcacatttaatatactgatcggtggatactgcctagtcggcaagatggaggatgcctcaaaaatatttgatgatatgatgtcatatggcttagaaccttctaatattacgtatggtatacttattaatggctattgcaaaaatagaaggattgatgacgggcttattctgttcaaagagatgctgcgcaagggacttaaacctacaacttttaattataacgtcatactggatggattatttctggctggacaaactgttgctgcaaaagagaagtttgatgagatggttgaatctggagtaagtgtgtgcattgatacatactctatagttcttggtggactttgtagaaatagctgcagtagcgaagcgatcaccctgttccgaaaattaagcgcaatgaatgtgaaatttaatattacaattgtcaataccattattggtgccttctacagggtcgagagaaaccaagaggctaaggatttgcttgctgctattccagccagtggcttggttcctaatgttgttacgtacaccataatgattaaaaatcttataaaagaaggttcagtggaagaagctgacaatctttttttatcgatagagaagagcggctgtagtgccaactcttatctgttaaatcatatcatcagaaggttactggaaaaaggagagacagtcaaggctggaaattatatgtctaaagttgatgcaaagagctactcacttgaagctaaaactgtttcgctgctgatctctctgttttcaaggaaagggaaatatagagaacacatcaaattgctccctacaaagtatcagtttctggaagaagcagccacagttgaa

SEQ ID NO: 2052 - DNA, 801 bp, Triticum aestivum
atggaggatgcctcaaaaatatttgatgatatgatgtcatatggcttagaaccttctaatattacgtatggtatacttattaatggctattgcaaaaacgaaaggattaacgatgggttgattctgttcaaagagatgctgcgcaagggacttaaacctacaacttttaattataacatcatactggatggattatttctggctggacaaactgttgctgcaaaagagaagtttgatgagatggttgaatctggagtaagtgtgtgcattgatacatactctatagttcttggtggactttgtagaaatagctgcagtagcgaagcgatcaccctgttccgaaaattaagcgcaatgaatgtgaaatttaatattacaattgtcaataccattattggtgccttctacagggtcgagagaaaccaagaggctaaggatttgtttgctgctattccagccagtggcttggttcctaatgttgttacctacaccataatgattaaaaatcttataaaagaaggttcagtggaagaagctgacaatctttttttatcgatggagaagagcggctgtagtgccaacttttatctgttaaatcatatcatcagaaggttactggaaaaaggagagatagtcaaggctggaaattatatgtctaaagttgatgcaaagagctactcccttgaagctaaaactgtttcactgctgatctctctgttttcaaggaaagggaaatatagagaacacatcaaattgctccctacaaagtatcagtttctggaagaagcagccacagttgaa

SEQ ID NO: 2053 - DNA, 1989 bp, Triticum aestivum
atggactgctgctgccgcgcaaaccgccaggatctggcgctcgccttcttcggccgtctcctcaggacgggacttaaggcaggcgtcatagaagtcaacactcttctcaagggactctgccgcgcaaagcgggctgatgaggctctggacattctgcttcacaggatgcctgagcttggctgcgcccccaacgtggtggcatataccacggtcatccacggcttctttaaggaaggccaagtaagcaaggcatgcaatctattccatgaaatggcgctgcagggcgttacacctgatgtggtgacatataactcggttattgatgcgctgtgcaaggccagagccatggacaaggcagagtatttccttcgtcaaatggttgataatggtgtcgtacctaataatgtgacatatagtagcctcatccatggatattcctcttcaggccattggaaggaggcagttagggtattcaaagagatgacaggtcggagggttacaccagatgtgcatacttacaacatgtttatgacctttctttgcaaacatggaagaagcaaagaagctgcaggaatttttgataccatggctatgaagggcctgaaacctgacaacgtttcatatgctattcgccttcatgggtatgccaccgaaggatgcttagttgatatgattaatctcttcaattcaatggaaagagactgtattctacctgactgtcatatcttcgacatactgattaatgcatatgctaaatctgggaagcttgataaggctatgcttatcttcaatgaaatgcagaaacaaggagtgagtccaaatgcagtcacatattcaaccataatacatgcattttgcaaaaagggtaggttggatgatgctgtgataaagtttaatcagatgattgatacaggagtacgacagggcacagctgtttatcgttccctaatccaaggtttttgtacacacggcgatttggtgaaagcaaaggaattgcttactgaaatgatgaacaaaggtatacctcctcctgatattaagttcttccattcaatcatgcagaacctatgcacagaaggaagggtaatagaagcacgggatatccttggcttgatagcacacataggtatgaggcctaatgtttgcacatttaatatactgatcggtggatactgcctagtcggcaagatggaggatgcctcaaaaatatttgatgatatgatgtcatatggcttagaaccttctaatattacgtatggtatacttattaatggctattgcaaaaatagaaggattgatgacgggcttattctgttcaaagagatgctgcgcaagggacttaaacctacaacttttaattataacgtcatactggatggattatttctggctggacaaactgttgctgcaaaagagaagtttgatgagatggttgaatctggagtaagtgtgtgcattgatacatactctatagttcttggtggactttgtagaaatagctgcagtagcgaagcgatcaccctgttccgaaaattaagcgcaatgaatgtgaaatttaatattacaattgtcaataccattattggtgccttctacagggtcgagagaaaccaagaggctaaggatttgtttgctgctattccagccagtggcttggttcctaatgttgttacgtacaccataatgattaaaaatcttataaaagaaggttcagtggaagaagctgacaatctttttttatcgatagagaagagcggctgtagtgccaactcttatctgttaaatcatatcatcagaaggttactggaaaaaggagagacagtcaaggctggaaattatatgtctaaagttgatgcaaagagctactcacttgaagctaaaactgtttcgctgctgatctctctgttttcaaggaaagggaaatatagagaacacatcaaattgctccctacaaagtatcagtttctggaagaagcagccacagttgaa

SEQ ID NO: 2054 - DNA, 777 bp, Triticum aestivum
atgaactgctgctgccgcgtctgtcgtccagaccttgggtttgccttatttggccgcctcctaaggagaggcctcaaaacagatgatatcgtcaccaacaccctcctcaagtgcctctgctgcgcaaaacggacagacgaggctgtcagcgtgctgcttcataggatgtccaagcttggttgtgtgcctgatgtcatctcatacaacacagttcttaagagcttatgtgataatagcagcagccagcgggcgctcgacctccttcagatgatgacgaaaggaggtggctgctcccctgacgtagtgacatacaacacggtcatccatggcttcctgcaggaaggggaagtaagcaaggcatgcgatcgataccatgaaatggtgcagcaaggggttctgcatgatgtggtgacatataattcgattcttgatgcgctgtgcaaggcaggagctatggacaaggctgagttgttccttcagcagatggctgatgatgatattcgaccgaatgaagtgacatataatgcaatgatccatggatattccactttgggccagtggaaaagggcgactcaaatgtttagagaaatgacaagccgtggtcttgctccaaatattgttacttggagctcgttgatgacctccctctgcaagcatggaagaagcaaagaagctgcagaaattttcattccatggctgcaaaaggccacaagcctaacatcgttacgtatcgtgttctgcttcacgggtatgccgctgagggattctttgcagata

SEQ ID NO: 2055 - DNA, 1821 bp, Triticum aestivum
atgatgacgaaaggaggtggctgctcccctgacgtagtgacatacaacacggtcatccatggcttcctgcaggaaggggaagtaagcaaggcatgcgatctataccatgaaatggtgcagcaaggggttttgcatgatgtggtgacatataattcgattcttgatgcgctgtgcaaggcaggagctatggacaaggctgagttgttccttcggcagatggttgatgatgatattcgaccgaatgaagtgacatataatgcaatgatccatggatattccactttgggccagtggaaaaaggcgactcaaatgtttagagaaatgacaagccgtggtcttgctccaaatattgttacttggagctcgttgatgacctccctctgcaagcatggaagaagcaaagaagctgcagaaatttttcattccatggctgcaaaaggccacaagcctaatatcgttacgtatcgtgttctgcttcacgggtatgccgctgaaggattctttgcagatatgattgatctctttaattcaatggcaaacaatggtattgtacccgattgccacgttttcaacatattaattaatgcatatgctaaatgtggaatgatggatgaagctatgtcaatgcttactgaaatgcggggacaaggagtgagtccggatgtgttcacctatgcaactgtaatagctgcactttgcagaatgggtaggttgactgatgctatggacaattttaatcggatgattgggaagggagtacaaccgagcaaagttgtttatcactccctaattcagggtttctgtacgcatggtaatctggtgaaagtgaaggagttgatttttggaatgacggacaaaggtattcctcaccctaacattgtcttcttcagttcaataatgcatagtctgtgcaacgaaggaagggttatggatgcacaccatatctttgacttggttatagacattggtgagagacctgatctcattacgtttaatacgctgattgacggatattgcttagtcagcaagatggaggaagcactccgactacttgattccatggtatcagctggcattaagccaaatgtgattacatataatacacttattaatggctattgtaggagtggaaggctcgatgatggcgttattctattcagagaaatgttgcataccagagttaaacctaacactgttacatataacatcatactggatgggttatttcgtgctggaagaactgttgctgcgaagaagatgttccatgagatgatcgaaactggaacagcagtgagcatttccacatacagcatagttcttggaggactttgtaggaataactgcaccgatgaagcaatcacttttttccagaaattagttgcaatgaatgtgaagtccgatattgcgatactcaataccatgattaaggcaatgtacaaggttcagagaagagaagaagctaacgatttgtttgcttcattaccagcctatggactggtgcctaatgctgctacttacagagtaatgataagcaatcttttgaaagaaggatcattggaagaagctgacaatatgttctcgtcaatggagaaaagtggttgtgctccaagctctcgtcttgtaaatgatatcatcagaaaattattggaaaagggggagatagtcaaggccggaaattatatgtcgaaagttgacgggaagatcatctcctttgaagcttcaaccacttcgttgttgttgtctctcttttcggagaaaggcaaatatcgggaacaattacaattgctccctgcgaaataccaactttttgagggagtcatt

SEQ ID NO: 2056 - DNA, 1395 bp, Triticum aestivum
atggctgcaaaaggccacaagcctaacatcgttacgtatcgtgttctgcttcacgggtatgccgctgagggattctttgcagatatgattgatctctttaattcaatcgcaaacaatggtattgtacccgattgccacgttttcaacatattaattaatgcatatgctaaatgtggaatgatggatgaagctatgtcaatgcttactgaaatgcggggacaaggagtgagtccggatgtgttcacctatgcaactgtaatagctgcactttgcagaatgggtaggttgactgatgttatggacaattttaatcggatgattgggaagggagtacaaccgagcaaagttgtttatcactccctaattcagggtttctgtacgcttggtgatctggtgaaagtgaagaagttgatttttgaaataacggacaaaggtattcctcaccctaacattgtcttcttcagttcaataatgcatagtctgtgcaacgaaggaagggttatggacgcacaccatatctttgacttggttatagacattggtgagagacctgatctcattacatttaatatgctgattgacggatattgcttagtcagcaagatggaggaagcactccgactacttgattccatggtatcagctggcattaagccaaatgtgattacatataatacacttattaatggctattgtaggagtggaaggcttgatgatggcgttattctattcagagaaatgttgcataccagagttaaacctaacactgttacatataacatcatactggatgggttatttcgtgctggaagaactgttgctgcgaaaaagatgttccatgagatgatcgaaactggaacagcagtgagcatttccacatacagcatagttcttggaggactttgtaggaataactgcaccgatgaagcaatcgcttttttccagaaattagttgcaatgaatgtgaagttcgatattgtgatactcaataccatgattaaggcaatctacaaggttcagagaagagaagaagctaacgatttgtttgctttattaccagcctgtgggctggtacctaatgcctctacttacggagtagtaatacagaatcttctgaaagaaggatcgttggaagaagctgacaatatgttttcatcaatggagaagagtggttgtgctccaagctctcgtcttgtaaatgatatcatcagaaaattattggaaaagggggagatagtcaaggccggaaattatatgtcgaaagttgacgggaagatcatctcctttgaagtttcaaccacttcgttgttgttgtctctcttttcggagaaaggcaaatatcgggaacaattacaattgctccccgcgaaataccaattttttgagggagtcatt

SEQ ID NO: 2057 - DNA, 1821 bp, Triticum aestivum; identical to SEQ ID NO: 2055

SEQ ID NO: 2058 - DNA, 1821 bp, Triticum aestivum
atgatgacgaaaggaggtggctgctcccctgacgtagtgacatacaacacggtcatccatggcttcctgcaggaaggggaagtaagcaaggcatgcgatctataccatgaaatggtgcagcaaggggttttgcatgatgtggtgacatataattcgattcttgatgcgctgtgcaaggcaggagctatggacaaggctgagttgttccttcggcagatggttgatgatgatattcgaccgaatgaagtgacatataatgcaatgatccatggatattccactttgggccagtggaaaaaggcgactcaaatgtttagagaaatgacaagccgtggtcttgctccaaatattgttacttggagctcgttgatgacctccctctgcaagcatggaagaagcaaagaagctgcagaaatttttcattccatggctgcaaaaggccacaagcctaatatcgttacgtatcgtgttctgcttcacgggtatgccgctgaaggattctttgcagatatgattgatctctttaattcaatggcaaacaatggtattgtacccgattgccacgttttcaacatattaattaatgcatatgctaaatgtggaatgatggatgaagctatgtcaatgcttactgaaatgcggggacaaggagtgagtccggatgtgttcacctatgcaactgtaatagctgcactttgcagaatgggtaggttgactgatgctatggacaattttaatcggatgattgggaagggagtacaaccgagcaaagttgtttatcactccctaattcagggtttctgtacgcatggtaatctggtgaaagtgaaggagttgatttttgaaatgacggacaaaggtattcctcaccctaacattgtcttcttcagttcaataatgcatagtctgtgcaacgaaggaagggttatggatgcacaccatatctttgacttggttatagacattggtgagagacctgatctcattacgtttaatacgctgattgacggatattgcttagtcagcaagatggaggaagcactccgactacttgattccatggtatcagctggcattaagccaaatgtgattacatataatacacttattaatggctattgtagaagtggaaggctcgatgatggcgttattctattcagagaaatgttgcataccagagttaaacctaacactgttacatataacatcatactggatgggttatttcgtgctggaagaactgttgctgcgaagaagatgttccatgagatgatcgaaactggaacagcagtgagcatttccacatacagcatagttcttggaggactttgtaggaataactgcaccgatgaagcaatcacttttttccagaaattagttgcaatgaatgtgaagtccgatattgcgatactcaataccatgattaaggcaatgtacaaggttcagagaagagaagaagctaacgatttgtttgcttcattaccagcctatggactggtgcctaatgctgctacttacggagtaatgataagcaatcttttgaaagaaggatcattggaagaagctgacaatatgttctcgtcaatggagaaaagtggttgtgctccaagctctcgtcttgtaaatgatatcatcagaaaattattggaaaagggggagatagtcaaggccggaaattatatgtcgaaagttgacgggaagatcatctcctttgaagcttcaaccacttcgttgttgttgtctctcttttcggagaaaggcaaatatcgggaacaattacaattgctccctgcgaaataccaattttttgagggagtcatt

SEQ ID NO: 2059 - DNA, 2088 bp, Triticum aestivum
atgaactgctgctgccgcgtctgtcgtccagaccttgggtttgccttatttggccgcctcctaaggacaggcctcaaaacagatgatatcgtcaccaacaccctcctcaagtgcctctgctgcgcaaaacggacagacgaggctgtcagcgtgctgcttcataggatgtccaagcttggttgtgtgcctgatgccatctcatacaacacagttcttaagagcttatgtgataatagcagcagccagcgggcgctcgacctccttcagatgatgacgaaaggaggtggctgctcccctgacgtagtgacatacaacacggtcatccatggcttcctgcaggaaggggaagtaagcaaggcatgcgatcgataccatgaaatggtgcagcaaggggttctgcatgatgtggtgacatataattcgattcttgatgcgctgtgcaaggcaggagctatggacaaggctgagttgttccttcggcagatggttgatgatgatattcgaccgaatgaagtgacatataatgcaatgatccatggatattccactttgggccagtggaaaagggcgactcaaatgtttagagaaatgacaagccgtggtcttgctccaaatattgttacttggagctcgttgatgacctccctctgcaagcatggaagaagcaaagaagctgcagaaatttttcattccatggctgcaaaaggccacaagcctaacatcgttacgtatcgtgttctgcttcacgggtatgccgctgagggattctttgcagatatgattgatctctttaattcaatcgcaaacaatggtattgtacccgattgccacgttttcaacatattaattaatgcatatgctaaatgtggaatgatggatgaagctatgtcaatgcttactgaaatgcggggacaaggagtgagtccggatgtgttcacctatgcaactgtaatagctgcactttgcagaatgggtaggttgactgatgttatggacaattttaatcggatgattgggaagggagtacaaccgagcaaagttgtttatcactccctaattcagggtttctgtacgcttggtgatctggtgaaagtgaagaagttgatttttgaaataacggacaaaggtattcctcaccctaacattgtcttcttcagttcaataatgcatagtctgtgcaacgaaggaagggttatggacgcacaccatatctttgacttggttatagacattggtgagagacctgatctcattacatttaatatgctgattgacggatattgcttagtcagcaagatggaggaagcactccgactacttgattccatggtatcagctggcattaagccaaatgtgattacatataatacacttattaatggctattgtaggagtggaaggcttgatgatggcgttattctattcagagaaatgttgcataccagagttaaacctaacactgttacatataacatcatactggatgggttatttcgtgctggaagaactgttgctgcaaaaaagatgttccatgagatgatcgaaactggaacagcagtgagcatttccacatacagcatagttcttggaggactttgtaggaataactgcaccgatgaagcaatcgcttttttccagaaattagttgcaatgaatgtgaagttcgatattgtgatactcaataccatgattaaggcaatgtacaaggttcagagaagagaagaagctaacgatttgtttgcttcattaccagcctgtgggctggtacctaatgcctctacttacggagtagtaatacagaatcttctgaaagaaggatcgttggaagaagctgacaatatgttttcatcaatggagaagagtggttgtgctccaagctctcgtcttgtaaatgatatcaccagaaaattattggaaaagggggagatagtcaaggccggaaattatatgtcgaaagttgacgggaagatcatctcctttgaagcttcaaccacttcgttgttgttgtctctcttttcggagaaaggcaaatatcgggaacaattacaattgctccccgcgaaataccaattttttgagggagtcatt

SEQ ID NO: 2060 - DNA, 1821 bp, Triticum aestivum; identical to SEQ ID NO: 2058

SEQ ID NO: 2061 - DNA, 1821 bp, Triticum aestivum; identical to SEQ ID NO: 2055

SEQ ID NO: 2062 - DNA, 921 bp, Triticum aestivum
atgtccaagcttggttgtgtgcctgatgccatctcatacaacacagttcttaagagcttatgtgataatagcagcagccagcgggcgctcgacctccttcagatgatgatgaaaggaggtggctgctcccctgacgtagtgacatacaacacggtcatccatggcttcctgcaggaaggggaagtaagcaaggcatgcgatcgataccatgaaatggtgcagcaaggggttctgcatgatgtggtgacatataattcgattcttgatgcgctgtgcaaggcaggagctatggacaaggctgagttgttccttcggcagatggttgatgatgatattcgaccgaatgaagtgacatataatgcaatgatccatggatattccactttgggccagtggaaaaaggcgactcaaatgtttagagaaatgacaagccgtggtcttgctccaaatattgttacttggagctcgttgatgacctccctctgcaagcatggaagaagcaaagaagctgcagaaatttttcattccatggctgcaaaaggccacaagcctaacatcgttacgtatcgtcttctgcttcatgggtatgccgctgagggattctttgcagatatgattgatatctttaattcaatggcaaacaatggtattgtacccgattgccacgttttcaacatattaattaatgcatatgctaaatgtggaatgatggatgaagctatgtcaatgcttactgaaatgcggggacaaggagtgagtccggatgtgttcacctatgcaactgtaatagctgcactttgcagaatgggtaggttgactgatgctatggacaattttaatcggatgatcgggaagggagtacaaccgagcaaagttgtttatcactccctaattcagggttctgtatgcatggtgatctgg

SEQ ID NO: 2063 - DNA, 2088 bp, Triticum aestivum; identical to SEQ ID NO: 2059

SEQ ID NO: 2064 - DNA, 1395 bp, Triticum aestivum; identical to SEQ ID NO: 2056

SEQ ID NO: 2065 - DNA, 777 bp, Triticum aestivum; identical to SEQ ID NO: 2054

SEQ ID NO: 2066 - DNA, 2088 bp, Triticum aestivum; identical to SEQ ID NO: 2059

SEQ ID NO: 2067 - DNA, 1821 bp, Triticum aestivum; identical to SEQ ID NO: 2055

SEQ ID NO: 2068 - DNA, 2088 bp, Triticum aestivum; identical to SEQ ID NO: 2059

SEQ ID NO: 2069 - DNA, 1707 bp, Triticum aestivum
atgatcaacctgggagttcaacctgatgcggtgacctacagctcatttatcaacgcactaagcaagtccggagcaatggacaaggcagaagtggtccttcggcaaatggttgatcaaggcattgtacccaatatcattacgtatactagtctgatccatgaatattccacttcgggtcagtggaaagcagcagttaggatattcaaagaaatgacaagtaccggtgttcgaccaaattctgtcacgttgaactcatttattgattccctttgcaagcatagaaagacaaaggaagctagagatatttttgactccatggccgcaaacggccacaaacctgatattttctcctactctactttgcttaacgggtatgtgaaagaaggatgcttcgatgatatgactgatctcttcaattcgatggtacggaatggtattgtacctaaccaccatgttttcaacatactgatcaatgcatatgctaaacgtggactgatggataaggctatgcacatgttcgaagtaatgaggcaacaaggagtaaacccagatgtatttagctatcaaattgtaatggattcactttgcaaaatgggcaggatggatgccgctctggacaaatttaatcagatggtcaatcaaggagtttcacctaacaaagctgtttaccaatgcctggttctgggttcttgctctcatggtcattttgtgaaagccaaggaattgatctctgaagcaattaatagaggtctgtattctaacagtgtgttcttctatcgtgtaataaacgacctttgcaaagaaggaaaggtaaacgaggcacaggatatgtttgacttcatcctaggtattggtcagcgacctgatgtgattatgtacacttcactgatggatggatattgccttgttggcgaggtggagaaagcactgagtgtactcgatgctatgaaatctgctggccttcaacctgatgatgttgtatatggtacacttcttaacggttactgtaaaattggaaggattgccgatggattgagccttttcagggaaatgtcactcagcgtggttaagcccacgactattatatacaacattatactggatgggctgttttgctctgggagaacagtttgtgcaaaggaaaattttgatatgatgattgaaagtggcataccagtgggcgttgacacatacaatatagttcttcatggactttgtagaaacaattgcactgatgaagcaatagagctgttcaagaaattatgtgctatgaatgtgaagattaatgtcataacactcaataccatgatttctgcattgtttaaaactaggagaattgaagaagccaaggatttgtttgctactatatcagccattgggttggtgccttctgttgtgacttacagtgtaatgatgacaaatttcataaaagaagggttgctggcagatgctgatgatatgttttcagcaatggagaaggctggctgtgctcccaactccagactgctaaatcaagtggtcagggtatttctgaagaatggtgaagttgtaaaggctgtgacttatcttgctaaacttgatgcaaaacagctgtcacttgaagcttcgacggtttcgttaatagtatctctcttctcaaggaaagggaaattaaggaagcatgtaaaattgcttccggtaaagtaccagcctcctgagatgttggac

SEQ ID NO: 2070 - DNA, 1884 bp, Triticum aestivum
atggactgttgctgccgcgcacaccgcctcgatctggcatttgctttcttcggccgtctcctcaggacgggactgaaggcaggcgtcatagaagtcaacactctcctcaaaggactctgccacacaaagcgggcggatgaggccatggaagtgcttcttcacaggatgcctgagctgggctgcacccctgacgtggtggcatataccacggtcatccatggcttctttaaggaaggccaagtaggcaaggcatgcagcctgttccatggcatggcgcagcagggcgttgcgcctgatgtcatgacatatagctcggttattgatgcgctgtgcaaggccaaagcaatggacaaggcagagtatttccttcgtcagatggttgataatggtgtcgtacctgataatgtcacatataatagcctcatccacggatattcctcttcaggccattggaaggaggcggtaagggtgctgaaagaaatgacaagtcaaggtatcatacctgatatcgtttcataccgtattctgcttcatgggtatgccaccgaagggtgcttagttgatatgattaatctcttcaattcaatggcaagatactgtattctacctgattgtcatatcttcaacatactgattaatgcatatgctaaatctgggaagcttgataaggctatgcttatatttagagaaatgcagaaacaaggagtgagtccagatgcagtcacatattcaaccgtaatacatgcattttgcaaaaatggcaggttggacgatgctgtgataaagtttaatcaaatgattgatacaggagtacaaccgaacacatctgtttataatgccctaatccaggggttttctacgaatggcgatttggtgaaggcaaaggaattggttacggaaatgatgaacaaaggtatgcatcctcctgatattaaggtcttccattcggtaatgcagaacctatgcacagaaggaagggtaacagaagcacgggatatccttgacttgatagtgcacataggtatgaggcctgatgttttcacatttactttactgattggtggatactgcctagtcggcaagatggaggatgcctcaaaaatatttgatgatatgatgtcatatggtttagaaccttgtaacattacgtatggtatacttattaatggctattgcaaaaatagaaggattgatgacgggcttattctgttcaaagagatgctgcacaagggacttaaacctacaacttttaattataacgtcatactggatggattatttctggctggacgaactgttgctgcaaaggaaaagtttgacgagatggttgaatctggagtaagtgtgtgcattgatacatattcgatagttcttggtggactttgtagaaataattgtagcggcgaagccattacgctattccagaaattaagcaaaatgaatgtgaaattcaatattagaattgtcaatttcatgattgatgccttcttcagggttcagcgaaagcaagaagctgaggatttgtttgctgcaatatcagcaaatgggttggttgctaatgtttttacctacagcctaatgatgacaaatcttataaaagaagggtcagcggaaaaagctgacactctctttttatcgatggagaagagcggctgtactgccaactcgtggatgttaaatcttattatcagaaggctactggaaaaaggagagatagtgaaggctggaaattatatggctaaagttgatgcaaagagctactcacttgaagctaaaactgtttcgctgctgatttctctcttttcagggaaagggaaatacagagaacacataagattgctgcctacaaagtatcagtttcgtgaagaagcagccacagttgaa

SEQ ID NO: 2071 - DNA, 2004 bp, Triticum aestivum
atggattgctgctgctgccgcgcacaccgcctggatctggcgctcgccttcttcggccatctcctcaagacgggcctggaggcagaccaagtcgtcttcaacaccctcctcaaaggcctttgccacgcaaagcgggcggatgaggctctggacgtgctgcttcacaggatgactgagctgggctgcacccccaacgtggtggcgtataacaccataatccatggcttctttaaggaaggtcaagtaagcaaggcatgcaatctgttccatgaaatggcgcagcagggcgttaagcctaatgtggtgacatataactcagttatcgatgcgctgtgcaaggccagagccatggacaaggctgaggtggtccttcgccaaatggttgataatggtgtcgtacctgataatgtcacatataatagcctcatccatggatattcctcttcaggccattggaaggaggcagttagggtattcaaagagatgacaagtcggagggttacagcagatgcgcatacttacaacatgtttatgacctttctttgcaaacatggaagaagcaaacaagctgcaggaatttttgattccatggctatgaagggcctgaaacctgacaacatttcatatgctattctccttcatgggtatgccaccgaaggatgcttagttgatgtgattaatctcttcaattcaatagaaagagactgtattctaccagactctcgtatcttcagcatactgattaatgcatatgctaaatctgggaagcttgataaggctatgcttatatttagagaaatgcagaaacaaggagtgagcccagatgcattcacatattcaactttaatacatgcattttgtaaaaagggtcggttggacgatgctatgataaagtttaatcagatggttgatacaggagtacgacagggcacagctgtttatggttctctaatccagggtttttgtacacacggcgatttggtgaaaggaaaggaattggttactgaaatgatgaacaaaggtatacctcctcctgatattatgttcttccattcaatcatgcagaacctatgcacagaaagaagggtagtagaagcacgggatatccttggcttgatagcacacataggtatgaggcctaatgtttgcacatttaatatactgattggtggatactgcctagtccgcaagatggaggatgcctcaaaaatatttcatgatatgatgtcatatggtttagaaccttctaatgttacgtatggtatacttattaatggctattgcaaaaacagaaggattgatgacgggctgattctgttcaaagaaatgttgcgcaagggacttaaacctacaacttttaattacaacatcatactggatggattatttctggctggacgaactgttgctgcaaaggaaaagtttgatgagatggttgaatctggagtaagtatgtgcatcagtacttactctatagttcttcgtggactttgtagaaataattgtagcggcgaagccatcacgctattccagaaattaagcgcaatgcatgtgaaattcaatattagaattgtcaatatcatgattgatgccttcttcagggttcagcgaaagcaagaagctaaggatttgtttgctgcactaacagccaatgggttggttgctaatgtttttacctacagcctaatgatgacaaatcttataaaagaagggtcagtggaagaggctgacacactctttttatcgatggagatgagcggctgtacttcgaactcgtggatgttaaatcttattatcagagggttgctggaaaaaggagagatagtcaaggctggatgttatatgtctaaagttgatgcgaagagctactcacttgaagctaaaactgtttcgttgctgatctatctcttttcagggaaagggaaatacagagaacacataagattgctacctacaaagtatcagtttctcgaagaagcagccacagttgaatggtttgctata

SEQ ID NO: 2072 - DNA, 2004 bp, Triticum aestivum; identical to SEQ ID NO: 2071

SEQ ID NO: 2073 - DNA, 2004 bp, Triticum aestivum; identical to SEQ ID NO: 2071

SEQ ID NO: 2074 - DNA, 1680 bp, Triticum aestivum
atggactgctgctgccgcgcacaccgcgtggatctgacgctggccttcttcggcggtctccttaggacgggcttggaggcagaccaagtcatcttcagcaccctcctcaagggactctgccacgcaaagcgcacagatgaggctctcaacgtcctgcttcacaggatgactgagttgggctgcacccctaacgtggtggcgtatagcacggtcatccatggcttcttcaaggaaggccaagtaggcaaggcgtgcagcctgttccatgaaatggcgcagcagggcgttgcgcctaatttggtgacatatacctcggttattgatgcgctgtgcaaggccaaagcaatggacaaggcagagtatttccttcgtcagatggttgataatggtgtcgtacctaataatgtcacatataatagcctcatccatggatattcctcttcaagccattggaaggaggcggttagggtattcaaagagatgacaagtcggagggttacagcagatgtgcatacttataacatgtttatgacctttctttgcaaacatggaagaagcaaagaagctgcaggattttttgattccatggctatgaagggcctgaaacctgacaacgtttcatatgctattctccttcatgggtatgccaccgaaggatgcttagttgatatgattaatctcttcaactcaatggaaaaagactctattctacctaactgtcatatcttcagcatactgattaatgcatatgctaaatctgggaagcttgataaggccatgcttatcttcagtgaaatgcagaaacaaggagtgagtccagatgcagtcacatatttacccgtaatagatgcattttgcaaaaagggtaggttggacgatgctgtgattaagtttaatcagatgattgatatgggagtacgaccagacacagctgtttatacttccctaatccaagttttttgtacacacggcgatttgctgaaagcaaaagaattggttactgaaatgatgaacaaaggtatacctcctcctgatattaagttcttccattcaatcatgcagaacctatgcacagaaggaagggtaatagaagcacgtgatatccttggcttgatagcacacataggtatgaggcctaatgtttgcacatttaatatactgattggtggatactgtctagtccgcaagatggaggatgcctcaaaaatatttgatgatatgatgtcatatggtttagaaccttctaatattacgtatggtatacttattaatggctattgcaaaaacttaaggattgacgatgggctgattctgttcaaagaaatgttacggaagggagttaaacctacaacttttaattataacgtcatactggatgggttatttctggctggacgaactgttgttgcaaaggaaaagtttcatgagatggttgaatctggagtaagtgtgtgcatcggtacttactctatagttcttggtggactttgtagaaatagttgcagtagcgaagcagtcacactattccagaaacgaaaaggtgcgatagcacccgggagtctagactcccttttatctggtccgtacagccttgtaaagattcgtgccaggctctgtatagcagcagctcatttgcagcgtcaggatttgaccgcgacaaacaatagtgctcgtaggctg

SEQ ID NO: 2075 - DNA, 1650 bp, Triticum aestivum
atgcactcaaatgaggcattggatctgctgctccaccggatgcccgaactggactgtgcgcctgatgtcttctcgttcaacatagtaatcaacggctgctttagagaaggtgaagtagacaaagcatgcaatctcttccatgagatgccccaactgggagttcaacctgatgtggtgacctacaactcaattatcatcgcactaagcagggccggagcaatgggtaaggcagaagtggtccttcggcaaatggttgataaaggcattggacctgatgtcatgacatataacagtctgatccatggatattctactttgggtcagtggaaggcagcagttagggtattcaaagagatggtaagtgttggtgttctaccaaatgctgtcacgttgaactcatttatggattcactttgcaagcatagaaggacaaaggaagctagagatatttttgactccatggctgcaaagggccacaaacctaatattgcctcctactctactatgcttaatgggtatgcgaaacaaggatgcttcgatgatatgactggtctcttcaattccatggtacagaatgatattgtacctaacaaccatgttttcaacatactgatcagagcatattctacacgtggactgatggacgaggctatgcacatgttcgaagtaatgaagcaacaaggagtaaacccagatgtagttgactatctagtagtaatagattcactttgcaaaatgggcaggatggatgctgctatggacaaatttaatcagatggtcaatcaaggagtttcacctgacatagttgtttaccaatgcctggttctgggttcttgctctaatggtgattttgtgaaagccaaagaattgatttctgaagcagttaatcgaggtctgtgttctaacagtgtgttcttctatcctgtaataaacaacctgagcaaagaaggaaatgtaaaggatgcacaagatatgtttgacttcattgtaggtattggtcatcagcctgatgttattatgtacaattcactgatggatggatattgccttgttggcaaggtggaggaagcaatgacagtgcttgatgctatgaagtccgctggcctccaacctgatgctattacgtatgctatacttcttaatggctactgtaaaattggaaggatcgacgatggattgagtctttttagggaaatctcactcagcagggttaagcccacgactattatgtacaacattatacttgatgggctgttttgctgtgggagaacagtttttgcaaaggaagaattcgatacaatgattgaaagtggcataccggtgggcattgacacatgcaccatagttcttagtggactttgcaaaaataattgcactgatgaagcaatagagctgttcaagaagttatgtgcaatgaatgtgaagtttgatgtcataattctcactaccatgatttctgcaatgtttaagactaggagaattgaagaagccaaggatttgtttgctactatatcaaccatagggttggtgccttctgttgtgacttacagtgtaatgatgacgaatttcataaaagaagggtcgctggsmswskctgatkatatgttttwagcratggagaaggctrkywktctsgaggaccttacarag

SEQ ID NO: 2076 - DNA, 1857 bp, Triticum aestivum
atgcactcaaatgaggctttggacatgctgctccaccggatgcccgaactggactgtgcgcctgatgtcttctcgttcaacatagtaatcaacggctgctttagagaaggtgaagtagacaaagcatgcaatctcttccatgagatgccccaactgggagttcaacctgatgtggtgacctacaactcaattatcatcgcactaagcagggccggggcaatgggtaaggcagaagtggtccttcggcaaatggttgataaaggcattggacccgatgtcatgacatataacagtctgatccatggatattctactttgggtcagtggaaggcagcagttagggtattcaaagagatggtaagtgttggtgttctaccaaatgctgtcacgttgaactcatttatggattcactttgcaagcatagaaggacaaaggaagctagagatatttttgactccatggctgcaaagggccacaaacctaatattgcctcctactctactatgcttaatgggtatgcgaaacaaggatgcttcgatgatatgactggtctcttcaattccatggtacagaatggtattgtacctaacaaccatgttttcaacatactgatcagagcatattctacacgtggactgatggacgaggctatgcacatgttcgaagtaatgaagcaacaaggagtaaacccagatgtagttgactatctagtagtaatagattcactttgcaaaatgggcaggatggatgctgctatggacaaatttaatcagatggtcaatcaaggagtttcacctgacatagttgtttaccaatgcctggttctgggttcttgctctaatggtgattttgtgaaagccaacgaattgatttctgaagcagttaatcgaggtctgtgttctaacagtgtgttcttctatcctgtaataaacaacctgagcaaagaaggaaatgtaaaggatgcacaggatatgtttgacttcattgtaggtattggtcatcagcctgatgttattatgtacaattcactaatggatggatattgccttgttggcaaggtggaggaagcaatgacagtgcttgatgctatgaagtccgctggcctccaacctgatgctattacgtatgctatacttcttaatggctactgtaaaattggaaggatcgacgatggattgagtctttttagggaaatctcactcagcagggttaagcccacgactattatgtacaacattatacttgatgggctgttttgctgtgggagaacagtttttgcaaaggaagaattcgatacaatgattgaaagtggcataccggtgggcattgacacatgcaccatagttcttagtggactttgcaaaaataattgcactgatgaagcaatagagctgttcaagaagttatgtgcaatgaatgtgaagtttgatgtcataattctcactaccatgatttctgcaatgtttaagactaggagaattgaagaagccaaggatttgtttgctactatatcaaccatagggttggtgccttctgttgtgacttacagtgtaatgatgacgaatttcataaaagaagggtcgctggcagaggctgatgatatgtttttagcaatggagaaggctggctgtgctcctgactccagactgctaaatcacgtggtcagagtgttgctggagaaaggtgcagttgtaaaggctgcaacttatctcgctaaacttgatggaaaacagctgtcacttgaagcttcgacggtttcgttaatagtatctctcttctcaaggaaagggaaattaagggagcatgtaaaattgcttccggtaaagtaccagcctcctgagagttcgactgacaat

SEQ ID NO: 2077 - DNA, 1566 bp, Triticum aestivum
atgcactcaaatgaggcattggatctgctgctccaccggatgcccgaactggactgtgcgcctgatgtcttctcgttcaacatagtaatcaacggctgctttagagaaggtgaagtagacaaagcatgcaatctcttccatgagatgccccaactgggagttcaacctgatgtggtgacctacaactcaattatcatcgcactaagcagggccggagcaatgggtaaggcagaagtggtccttcggcaaatggttgataaaggcattggacccgatgtcatgacatataacagtctgatccatggatattctactttgggtcagtggaaggcagcagttagggtattcaaagagatggtaagtgttggtgttctaccaaatgctgtcacgttgaactcatttatggattcactttgcaagcatagaaggacaaaggaagctagagatatttttgactccatggctgcaaagggccacaaacctaatattgcctcctactctactatgcttaatgggtatgcgaaacaaggatgcttcgatgatatgactggtctcttcaattccatggtacagaatgatattgtacctaacaaccatgttttcaacatactgatcagagcatattctacacgtggactgatggacgaggctatgcacatgttcgaagtaatgaagcaacaaggagtaaacccagatgtagttgactatctagtagtaatagattcactttgcaaaatgggcaggatggatgctgctatggacaaatttaatcagatggtcaatcaaggagtttcacctgacatagttgtttaccaatgcctggttctgggttcttgctctaatggtgattttgtgaaagccaaagaattgatttctgaagcagttaatcgaggtctgtgttctaacagtgtgttcttctatcctgtaataaacaacctgagcaaagaaggaaatgtaaaggatgcacaagatatgtttgacttcattgtaggtattggtcatcagcctgatgttattatgtacaattcactgatggatggatattgccttgttggcaaggtggaggaagcaatgacagtgcttgatgctatgaagtccgctggcctccaacctgatgctattacgtatgctatacttcttaatggctactgtaaaattggaaggatcgacgatggattgagtctttttagggaaatctcactcagcagggttaagcccacgactattatgtacaacattatacttgatgggctgttttgctgtgggagaacagtttttgcaaaggaagaattcgatacaatgattgaaagtggcataccggtgggcattgacacatgcaccatagttcttagtggactttgcaaaaataattgcactgatgaagcaatagagctgttcaagaagttatgtgcaatgaatgtgaagtttgatgtcataattctcactaccatgatttctgcaatgtttaagactaggagaattgaagaagccaaggatttgtttgctactatatcaaccatagggttggtgccttctgttgtgacttacagtgtaattttttttttt

SEQ ID NO: 2078 - DNA, 1896 bp, Triticum aestivum
atggcattccagtcgactgctgctgccgtgctggccgcttggaccttggacactgctgccatgggacacgtcattaagttgggatttgcagaagaatctattgtcaatttcagccacctactcaaggccatctgtgcggagaagaagaccagctgtgcaatggacatcgtactacgagtaatgcctgagcttaactgcacacccaacattttctcctacagcattcttttcaagggtctctgcaacgagaagagaagccaagaggctctcgacctgattcacatcatggttgagcatggaggtagctgccaacctaatgtggtgtcctatagcaccgtaattgatggcttgttgaaagagggtgaagtgaacaaggcttacagtctattttgtgaaatgttacagaggagaatttcgccggatgttgtgacctgtagttcgattatttctggcatgtgcaagcttcatgcgatggacaaggctgaggacgttcttcaacagatgcttgatagaggaattctgccagatgttgctacatatactagtctaatgcatggatattattcattaggacagtgcgaggaggtggatcggattttcaaagaaatgtctagaaatggtgttcaaccagatattgtaacttctaatatacagatggattatctttgcaagaatggaagatgtgcagaagctaggaagatttttgattccatggtcagtttgggccaaaaaccgactgttactacctacagtattctgcttcatgggtatgctatggaaagatcttttcatgatatgaattgtctcattgatttgatggtgggaaatggtattgcgccaaatcattttatctacaacatactcatatctgcatacgctaaagaagaaatggttgatgatgtattgcatatatttacaaaaatgcggcagcaaggattgaaccctaatgttgtgaactatggagctgtaataaacttgctttccagttttggccgaatggatgatgctatgtcccaattcaatcaaatgatagctgaagggttagctcctgatatcatagtttttaaccctcttattaggggtttctgttcttgtggcaaatggaagaaggttcatgaactattttctgagatgttggatcgcggcatctatcccaacacagtgttcttcaacacaattatggatcgcctttgcaaatatggaagggttatggaagcccaagatctcttcgacctgatggtacacatgggtgtgaagcctgatgtgtgtacttataacacactgataggtggatacttgttcgttggtaagatggatgaagtgagcaagttacttgacaatatggtctcaattggcatggaaccagatgttatcacctataacatactgattgatggttactctaagaatggaaggatagatgatgcattggttgtttccagggaaatgttggccgggaaggttaagccttgtgttatcacttttaatattatgattggtgcattgcttaaatgtggcaggaaggaagaggctaaagatttgtttgatggtatctgggctaaaggattagtgcccaccgttgttacatatagcttaatgatacaaaaacttatagaagaaggttctctacaagagtctgatgatctatttgtttctatggagaagaatggatgtgctgccgactcccatatgctaaatgctatagttagaagcttatttcggaaaggggaggtgcccagggctgggacttatctgtctaaaattgatgagaggagcttcacccttgaagcttccacagctagcttgttgactgcacttgcttcagggggaaaaggccaggaatacaaggagttactccccgaaaaataccactcttttctggaacagggcactgat

SEQ ID NO: 2079 - DNA, 1896 bp, Triticum aestivum; identical to SEQ ID NO: 2078

SEQ ID NO: 2080 - DNA, 1896 bp, Triticum aestivum; identical to SEQ ID NO: 2078

SEQ ID NO: 2081 - DNA, 1938 bp, Triticum aestivum
atgtccgagctcggctgtgtgcataatgccttctcatactccattgttctgaagagcttatgcgacaatagcatgagtcagcgggggctcgacatgctccagatgatggcgaaagaaggaggtgtctgcttccccaacgtggtggcatatagcacggttatccatggcttctttaaggagggcgaaacaggcaaggcatgcaatctcttccacgaaatgatgcagcaagggcttgtgcccgatgtggtgacatacaactcaatcattgacgcgttgtgcaaggccagggcaatggacaaggcagagctagtccttcggcagatggttgctaatggtgctcaacccgatacagtgacatataattgcatgatcaatggatatgccacatctgggcggttgaaagagtctgctaaaatgttcagagaaatgaaaagccggggtcttatgccagatattgttacttgcaactccttcctgtcctccctttgcaagcatggaagaagcaaagaagctgcagaattttttgattccatgaccgccaagggccacaaaccggatatcgtctcatgccgtattttgcttcatgggtatgctactgaaggatgctttgctgatatgattgatctctttaactcagtgggaagcaacggcattgcagccgactgccgtgttttcaaaatattaattaatcgatatgctaaacgtggaatgacagatgaagctatgctgatatttactgaaatgcggggacaaggagtaagtccaaatgtagtcacctattccattgtaatagccgcactttccagaaaactttccagaatgggtaggttgaccgatgctatggacaaatttgatcagatggttgccttgggagtacagccggatagatctatttatcagtcccttattcagggcttttttatgcatggtggtttggttaaagctaaggagttggtttctcaaatgataaacaaaggtattcctcgtcctgacattgtgttcttcaattcagtaataaacagtatgtgcaaggaaggcagggttatggatgcacatgatatctttgacttggttatagacataggtgagaggcctgatgacatttcatttaattcactgattgacggatattgcttagtcgggaatatggataaagcatttaagatacttgatgccatggaagttggtgttgagcctgatgttattacatataatacacttgttaatggctattgtagaaatggaaggatcgatgatggtttggctctgtttagagaaatgccgcataagagaattaaacctgacactgtaacatatgacatcatactgaatgggttgtttcattctgggagcactgttgctgcaagaaaaatgttccatgagatgatcgaaagtggaataacagtgagcattcccacatatggtataataattgctggtttttgtagaaataattgtgcagaggaagctatcgacctattccataaactaagtgctatgaatgtgaagtttgatattgcaatacacaatactatgattaatgcgatattcaaggttgggagaagagaggaagctaaggatttgtttgctgcaatatcacccagtgggttggtgcccacggaatctacttatgcagtaatgataacaaatcttctagaagatggagtagtggaagaagcagacaatatgttttcatcaatggagaaaagtggtataatccccagctcccgtctgttaaattgtatcatcagaatgttgttggaaaaaggtgagattgccaaggccggaaattacttgtctaaagttgatgggaagagcattttacttgaagcatcaacaactttattgatgttgtctttgttttcgaagaaaggcaaataccgggaggacatgaaattgctccctgcaaagtatcaattttttatggacttggttgac

SEQ ID NO: 2082 - DNA, 1938 bp, Triticum aestivum
atgtccgagctcggctgtgtgcataatgccttctcatactccattgttctgaagagcttatgcgacaatagcatgagtcagcgggggctcgacatgctccagatgatggcgaaagaaggaggtgtctgcttccccaacgtggtggcatatagcacggttatccatggcttctttaaggagggcgaaacaggcaaggcatgcaatctcttccacgaaatgatgcagcaagggcttgtgcccgatgtggtgacatacaactcaatcattgacgcgttgtgcaaggccagggcaatggacaaggcagagctagtccttcggcagatggttgctaatggtgctcaatccgatacagtgacatataattgcatgatcaatggatatgccacatctgggcggttgaaagagtctgctaaaatgttcagagaaatgaaaagccggggtcttatgccagatattgttacttgcaactccttcctgtcctccctttgcaagcatggaagaagcaaagaagctgcagaattttttgattccatgaccgccaagggccacaaaccggatatcgtctcatgccgtattttgcttcatgggtatgctactgaaggatgctttgctgatatgattgatctctttaactcagtgggaagcaacggcattgcagccgactgccgtgttttcaaaatattaattaatcgatatgctaaacgtggaatgacagatgaagctatgctgatatttactgaaatgcggggacaaggagtaagtccaaatgtagtcacctattccattgtaatagccgcactttccagaaaactttccagaatgggtaggttgaccgatgctatggacaaatttgatcagatggttgccttgggagtacagccggatagatctatttatcagtcccttattcagggcttttttatgcatggtggtttggttaaagctaaggagttggtttctcaaatgataaacaaaggtattcctcgtcctgacattgtgttcttcaattcagtaataaacagtatgtgcaaggaaggcagggttatggatgcacatgatatctttgacttggttatagacataggtgagaggcctgatgacatttcatttaattcactgattgacggatattgcttagtcgggaatatggataaagcatttaagatacttgatgccatggaagttggtgttgagcctgatgttattacatataatacacttgttaatggctattgtagaaatggaaggatcgatgatggtttggctctgtttagagaaatgccgcataagagaattaaacctgacactgtaacatatgacatcatactgaatgggttgtttcattctgggagcactgttgctgcaagaaaaatgttccatgagatgatcgaaagtggaataacagtgagcattcccacatatggtataataattgctggtttttgtagaaataattgtgcagaggaagctatcgacctattccataaactaagtgctatgaatgtgaagtttgatattgcaatacacaatactatgattaatgcgatattcaaggttgggagaagagaggaagctaaggatttgtttgctgcaatatcacccagtgggttggtgcccacggaatctacttatgcagtaatgataacaaatcttctagaagatggagtagtggaagaagcagacaatatgttttcatcaatggagaaaagtggtataatccccagctcccgtctgttaaattgtatcatcagaatgttgttggaaaaaggtgagattgccaaggccggaaattacttgtctaaagttgatgggaagagcattttacttgaagcatcaacaactttattgatgttgtctttgttttcgaagaaaggcaaataccgggaggacatgaaattgctccctgcaaagtatcaattttttatggacttggttgac

SEQ ID NO: 2083 - DNA, 1938 bp, Triticum aestivum; identical to SEQ ID NO: 2081

SEQ ID NO: 2084 - DNA, 1914 bp, Triticum aestivum
atgagccgccgctttgtccccctcgacagacgcatcttggagcggaacatcaaggctcggtaccacgccggagacattggcacccaggacgcactccacctgttcgacgaattgctccacgttgctgggccttcctcggtccgcgccatcaactgcctcctcaccgtggttggccgtgattgccccgcgctcggcgtctccctcttcaaccgcgtcgcaagagcaaaggtgcctccccacaatgtcacctatggcattctagtcgactgctgctgccgtgctggccgcctggaccttggacacgctgccatgggacgcgtcattaagttgggatttacagcagaagctatcgtcaatttcagccacctactcaaggccatctgtgcagagaagaagaccagttatgcaatggacatcgtactccggataatgcctgagtttaactgcataccaaacattttctcctataacattcttttcaagggtctctgcaacgagaagagaagccaagaggctcttgatctgattcaagttatggttgaggatggaggttgctgccaacctgatgtggtgacctataacactgtaattgatggcttgttgaaagagggtgaggtaggcaaggcttacagcctattttctgaaatgctgcgtcagggggtatcaccgaatgttgtgacatgtaattcaatcatctctggcatgtgcaagcttcacgcgatggacaaggctgaggaggttcttcaacagatgcttgatagaggaattctgccagatgttgccacatataatagtctgatacatggatattattcattaggacagtgcgaagaggtggatcggattttcaaggagatgactacaaatggtgttcaaccagatattgtaacttacaatatacagatggattatctttgcaagaatggaagatgcgcagaagctaggaagatttttgattccatgatcagtttgggccaaaaacctactgttactacctacaacattctgcttcatgggtatgctatggaaagatcttttcatgatatgaattgtctcattgagttgatggatgataatggtatttcaccagatcattatggctacaacatactcatatctgcttatgctaaagaaaaaatggttgatgatgtattgcatatatttacaaaaatgcggcagcaaggattgaaccctgatgttgcgaactatggagcggtaataaacttgctttctagtattggccgaatggatgatgctatgtcccaatacaatcaaatgataaatgaagggttagctcctgatatcatagttttcaactcccttattagtggtttctgttcttgtggcaaatgggagaaggttcatgaactattttctgagatgttggatcgcggcatctgtcccaacacagtgttcttcaccactattatggaccgcctttgcaaaaatggaagggttatggaagcccaagatctcttcgacctgatggtacacatgggtgtgaagcctgatgtgtggacttataacacactgataggtggatacttgttcattggtaagatggatgaagtgagcaagttacttgacaatatgtgctcaattggcttgaaaccaaatgttttcacctatggcatactgatcgatggttactctaagaatggaagtatagatgatgcactggttgttatcagggaaatgttggacggtgttaagccttctattatcacttttaatattatgattggtgtgttgcttaaaggtagcaggatggaagaagccaaagatttgtttgacggtatctgggccaaaggattagtgcctgacgttgttacatatagcttaatgatacaaaaactaatagaagaaggttctctgactgtagtaaacttcttccatcaagctagtaaacttctc

SEQ ID NO: 2085 - DNA, 1914 bp, Triticum aestivum; identical to SEQ ID NO: 2084

SEQ ID NO: 2086 - DNA, 1914 bp, Triticum aestivum; identical to SEQ ID NO: 2084

SEQ ID NO: 2087 - DNA, 1845 bp, Triticum aestivum
atgagaatcttaaaatatgagacagtgatcacgtcaaccaaatatttaaataccaaacaaattcaaaatatccaacaaaattgcatgatgcatgcttgtacgaacaccacccaatcccatgcactccgagtaaaatgcatggtgcgctcaggcccagcaaatcggatcccagtcgcgccgagtccacacctccgtccaccgtcctcccgccgctggacgcgcccggtcggtcgtcgccggcgcgcgctcggactcaccgtcgccgcaggaagaagcgagcgacaccaccggacgcgcccgtcctccttccaccagagtaaggtcttggtcgttgcctcccgcattcaccgctgcagaaattggacggcgacaatgtcacgccttcaggtccgctctttctccagccccgtttcctcacgcgccaacgatctgctgagcgaactccaaggccatctgggcttcaggacgctcaggccagagctcgcgcaccaactgttcgaccaaatgatgcgccaacctgtcccagtatcagcgcgtgcactcaacggcttatttgctgccctcgcgcgtgcgccgccctccgccgcctgcaccgacggccctgccctcgccatcgatcttttcaaccgcatggcccgagcaggccgccgcagggtgatagcactcaccagtcacacctacagcatactaattgaatgctgctgccgcgtgcgccgtccggacctagggccttccttcttcgctcaccttctcaagacaggcgtcacggcaaacatcgtaatctatagtggcttaatcaagtgcctctgcgacttgaagtgcacagaggaggctctggatgtgctgctccacaggatgccgaacaacataagtgatgccatctcctactcagtaattctcaagagtttctgcgacagtgggaggagccagcttgcgcttgacctgctccacatgatggccaaaaaaggagctgaccactccccggatgtgcttgcatacaacatggtaattgatggcttctttaaggaaggtgaagtaagcaaaacatttgatctgttccatgaaatgatacagcaggggcctgtgcctgatgtggtgacgtatagcttctttatcaatgcgctatgcaaagcaagagcaatggacaaggcagaggtggttcttcgatcaatgattcataatggtgtccaaccagatgctgtgacatataatagcttgatccaaggatttttaacttcgggtcagctgaaagaagcctttaggttgttgaaactgatgacaaggcaaggtgttattccagacgttgttacctgcaactcagtcatggactacctttgcaagcatggaagagtcaaagaagctgcagaaatattttattccacggctgtgaagggccgaaaaccagatatagtctcatactctattatgctccatgggtacgctatagaaggatcccttgttaaaatgattgatctctgtgagatgatggcaagagatggagttgtacccgacctctcttgtttcaacatactgattaaggcatatgctaagtatggcaggatggatgtggccatgcttttctttgaagacatgttgaagcagggtgtgaagcctaatgaactcacttatttaactgtgatatctgcgttttgcaagatgggcaggatggatgatgcgatggaaaaattcagtgagatgattaatatgggagtaccacttgacacagaagtttacatgtgcatggttgagggttatttgaatcttggcgattccatgaaagccaaggaatttattaccaaaatgaagaacagggatattcatcataagccatggaaaggtaatcga

SEQ ID NO: 2088 - DNA, 1806 bp, Triticum aestivum
atgcctcgcttctcctccaccacgtcaatgtcgtcactccgcctccgcctccgcctccacgcccgccactcctcctccgcctcgcaaccctcacgcagccagggatgggatccccacgccgccttcgccgccgccacggagcgtgcgcgctccggcaacctcaccccggaggacgcacataacctgttcgacgaattgctgcggcagggcaatcctgtcctggagcgccccctcaacaaccttctcgccgccctcgcccgcgcgccggcgtccagcgcctgcggagacggccctgcactcgcggtcgccctcttcagccgcatatcccaaggtgcccgcctaagggtggcgcatccaacggcttgcacctacagcatcctcatggactgctgctaccgtgcacgctgccctgatctgtcactcgccttcttcggtcgtctcctcaggacgggcctgaaggcagaccaattcgttttcagcaccctcctcaagggactctgccacgcaaagcgctcagatgaggctctggacgtgctgcttcacaggatgcctgagctgggctgcactccctatgtggtggcgtataacaccgtcatccatggcttctttagggaaggccaagtaggcaaggcgtgcaatctattccatgaaatgaggcagcagggcgttacacctgatgttgtgacatataactcggttattgatgcgttgtgcaaggccaaagcaatggacaaggcagagtatttccttggtcagatggttgatgatggtgtcgtacctgataatgtgacatataatagcctcatccatggatattcctcttcaggccactggaaggaggctgttagggtattcaaagagatgacaagtcggagggttacagcagatgtgcatacttacaacatgtttatgacctttctttgcaaacatggaagaagcaaggaagctgcaggaatttttgataccatggctatgaagggcctgaaacctaacatcgtctcgtacagtactctgcttcatgggtatgccaccgaaggatgcttaattgatatgattaatctcttcaattcaatggaaagagactgtattctacctaactgtcatatcttcagcatactgattaatgcatatgctaaatctgggaagcttgataaggctatgcttatcttcaatgaaatgcagaaacaaggattgagtccagacgcattcacatatttacccgtaatagatgcattttgcaaaaagggtaggttggacgatgctatgattaagtttaatcagatgattgatacgggagtacgaccagacacagctgtttatacttccctaatccaaggtttttgtacacatggcgatttggtgaaagcaaaggaattggttactgaaatgatgaacaaaggtatacctcctcctgatattaagttcttccattcaatcatgcaaaacctatgcacggaaggaagagtaacaaaagcatgggatatccttggcttgatagcacacattggtatgaggcctaatgttgtcacatttagtgtacttgtcggtggatactgcctagtccgcaagatggcagatgcatcgaaagtatttgatgatatggtgtcatatggtttagaaccttgtaacattatgtatggtatacttattaatggctattgcaaaaatagaaggattgatgacgggcttattctgttcaaagagatgctgcacaagggacttaaacctacaacttttaattataacgtcatactgaatggattatttctggctggacaaactgttgctgcaaaagagaagtttgat

SEQ ID NO: 2089 - DNA, 1806 bp, Triticum aestivum; identical to SEQ ID NO: 2088

SEQ ID NO: 2090 - DNA, 1806 bp, Triticum aestivum; identical to SEQ ID NO: 2088

SEQ ID NO: 2091 - DNA, 1806 bp, Triticum aestivum; identical to SEQ ID NO: 2088

SEQ ID NO: 2092 - DNA, 1806 bp, Triticum aestivum; identical to SEQ ID NO: 2088

SEQ ID NO: 2093 - DNA, 1806 bp, Triticum aestivum; identical to SEQ ID NO: 2088

SEQ ID NO: 2094 - DNA, 1854 bp, Triticum aestivum
atgagccagcgggcgctcgacctgctccagatgatggcgaaagaaggaggtggctgctcccccaacgtggtggcgtatagcacggtcatccgtggcttttttaaggaaggtgaaacaggcaaggcatgcaatctgttccatgaaatgatgcagcaaggtgttgagcccagtgtgtggacatatagctcaatcattgatgcattgtgcaaggccagagcaatggacaaggcagagctagtgcttcagcagatggttaacaaaggtgttcaacccaataatgtgacatataattgcatgatccatggatattccacatctgggcagtcgaaagaggctgctaaattgcttagagaaatgaaaagccgggaccttataccagatattgtcactcgcaactcgttcctggcctccctttgcaagcatgggagaagcaaggaagctgcagaatttcttgattccatgactgccaagggccacaaaccagatatcgtatcataccgtattttgcttcatgggtatgccagtgaaggatgctttgctgatatgattgatctctttaattcaatggaaagcaacggtattgcagctgactgccatgttttcaacatattaattaatggatatgcaaaacgtggaatgacagaagaagctatgctgatatttactgaaatgcggggacaaggagtgagtccagatgtagtcacctattccattgtaatagccgcactttccagaatgggtaggctgaccgatgctattgagaaattcaatgagatgactgccttggaagtacagccggacacaactgtttatcactcactgattcagggttgttgcatagacggtgatttggttaaagctaaggagctgatgtttgaaatgatgaacggtggtattcctcggcctaacattgtgttcttcaattcagtaataaacagtctgtgcaaagaaggaagggttatggatgcacatgatgtcttagacttggttataggcataggtgagaggcctgatgtcattacatttaattcactgattgacggatattgcttagtcgggaagacggataaagcattcaaaatacttgatgtcatgaaatcagttggtgttgagtctgatgttgttacttatagtgcacttcttgatggctattttaaaaacagaaggattgatgatgctttgactttgtttagagaaatgccgcgtaagagaattaaacctggcactgttacatatggcatcatgttggatgggttgtttcgtgctgggagaactgttgccgcaaagaaaatgttccatgagatgaacgagagtggaacaacggtggacatttccacatacaatataatactgggaggtctttgtagaaataagtgtgcagacgaagcgatcacactgttccagaaattacgagcaatgaatgtgaagttaaatattaaaatactcaataccatgattaatgcaatgtacacggttcaaagaaaggaagaggctaaggatttgttttctgcaatgtcagccaatgggttggtgcccaatgaatctacttatgcagtaatgataagaaatcttctaaaagacggagcagtggaagatgctgacaatatgttttcatcaatggacaacagtggtatcattcccagttcctgtcttataaatgatatcatcagaatgttgttggaaaaaggtgagatagccaaggctggaaattatttgtctaaagttgatgggaagaggatctcacttgaagcttcaactacctcattgatgttgtctctcttttcaaggaaagggaaacatcaggaggatattaagttgctccctgcaaagtatcaatttttcgatggatttggt

SEQ ID NO: 2095 - DNA, 1854 bp, Triticum aestivum; identical to SEQ ID NO: 2094

SEQ ID NO: 2096 - DNA, 1854 bp, Triticum aestivum; identical to SEQ ID NO: 2094

SEQ ID NO: 2097 - DNA, 1854 bp, Triticum aestivum; identical to SEQ ID NO: 2094

SEQ ID NO: 2098 - DNA, 1854 bp, Triticum aestivum; identical to SEQ ID NO: 2094

SEQ ID NO: 2099 - DNA, 1854 bp, Triticum aestivum; identical to SEQ ID NO: 2094

SEQ ID NO: 2100 - DNA, 960 bp, Triticum aestivum
atggattatctttgcaagaatggaagatgcgcagaagctaggaagatttttgattccatggtcagtttgggccaaaaaccgactgttactacctacagcattctgcttcatgggtatgctatggaaagatcttttcatgatatgaattgtctcattgatttgatggtgggaaatggtattgctccaaatcattttatctacaacatactcatatctgcatacgctaaagaagaaatggttggtgaggtaatgcatatatttacaaaaatgcggcagcaaggattgaaccctgatgttgcgaactatgaagcggtaataaacttgctttctagtattggccgaatggatgatgctatgtcccaatacaatcaaatgataactgaaggattactccctggtatcatacttttcagccaacttattagtggtttccgtacttgtggcaaatgggagaaggttcatgaactattttctgaaatgttggatcgtggcatctatcccaacactgtgttcttgaacacaattatggatcatctttgcaaaaatggaagggttatggaagcccaggatctcttcgacctgatggtacacatgggtgtgaaacctgacgtgtgtacttatagcacactgataggtggatacttgttcgttggtcagatggatgaagtgagcaagttacttgacaatatggtctcaattggcttgaaaccaaatgttatcacatataccatattgattgatggttactgtaagaatggaaggatagatgatgcattggttgttttcagggaaatgttggccgggaaggttaagccttgcattatcacttttaatattatgattggtgcgttgcttaaaggtggcaggaaggaagaggctaaagatttgtttgatggtatctgggccaaaggattagtgcccaccgttgttacatatagcttaatgatacaaaaacttata

SEQ ID NO: 2101 - DNA, 1863 bp, Triticum aestivum
atgagccgccgcgtcgtccccgtcggcaggcgcatcttggagcagaacatcaaggctcggtaccacgccagagacattggcaccgaggatgcactccacctgtttgacgaattgctccaggatgctcagccctcctcgatccatgccatcaactgcctcctcaccatcatccgccgtgattgccctgcactgggcgtctccctcttcaaccgcatcgcaagggccaaggtggcacccgacattatcacctatggcattctagtccaatgctgctgccgtgctggccgcttggaccttggacatgctgccatgggacacatcattaagttgggatttgcagcagaatccatcgtcaatttcaatcacctactcaaagccatctgcgccgagaagaagaccagctacgcaatggacatcgtactccggctaatgcccgagtttaactgcataccaaacattttctcctacaacattcttttcaagggtctctgcaacgagaagagaagccaagaggctcttgagctgattcaaattatggttgaggatggaggttgctgccgacctgatgtggtgacctataacactgtagtcgatggcttgttgaaagagggtgaggtaggcaaggcttacagcctattttctgaaatgctacatagggggatttcgccaaatgctgtgacctatagctcaatcatctgtggcatgtgcaggcttcatctgatggacaaggctgaggaggttcttcaacagatgtttgatagagaaattctgccagatgttgctacatatactagtctaatacatggatattattcattaggacagtgcgaggaggtggatcggattttcaaagaaatgtctagaaatggtgttcaaccagatatcgtaacttataacatacagatggattatctttgcaagaatggaagatgcgcagaagctaggaagatttttgattccatggtcagtttgggccaaaaaccgactgttactacctacagcattctgcttcatgggtatgctatggaaagatcttttcatgatatgaattgtctcattgatttgatggtgggaaatggtattgctccaaatcattttatctacaacatactcatatctgcatacgctaaagaagaaatggttggtgaggtaatgcatatatttacaaaaatgcggcagcaaggattgaaccctgatgttgcgaactatgaagcggtaataaacttgctttctagtattggccgaatggatgatgctatgtcccaatacaatcaaatgataactgaaggattactccctggtatcatacttttcagccaacttattagtggtttccgtacttgtggcaaatgggagaaggttcatgaactattttctgaaatgttggatcgtggcatctatcccaacactgtgttcttcaacacaattatggatcatctttgcaaaaatggaagggttatggaagcccaggatctcttcgacctgatggtacacatgggtgtgaaacctgacgtgtgtacttatagcacactgataggtggatacttgttcgttggtcagatggatgaagtgagcaagttacttgacaatatggtctcaattggcttgaaaccaaatgttatcacatataccatattgattgatggttactgtaagaatggaaggatagatgatgcattggttgttttcagggaaatgttggccgggaaggttaagccttgcattatcacttttaatattatgattggtgcgttgcttaaaggtggcaggaaggaagaggctaaagatttgtttgatggtatctgggccaaaggattagtgcccaccgttgttacatatagcttaatgatacaaaaacttata

SEQ ID NO: 2102 - DNA, 1863 bp, Triticum aestivum; identical to SEQ ID NO: 2101

SEQ ID NO: 2103 - DNA, 1866 bp, Triticum aestivum
atgaggctctggacattctgcttcacaggatgcctgagcttggctgcacccctgacgtggtggcgtgacgtggtggcgtataacacggtcatccatggcttctttaaggaaggccaagtaggcaaggcatgcaatctgttccatggaatggcgcagcagggcgttgcgcctaatttggtgacatataactcggttattgatgcgttgtgcaaggccaaagcaatggacaaggcagagtatttccttggtcagatggttgatgatggtgtcgtacctgataatgtgacatataatagcctcatccatggatattcctcttcaggccactggaaggaggctgttagggtattcaaagagatgacaagtcggagggttaaaccaaatgtgcatactcacaacatgtttatgacctttctttgcaaacatggaagaagcaaagaagctgcaggaatttttgataccatggctatgaagggcctgaaacataacaacgtttcatatgctattctccttcacgggtatgccaccgaaggatgcttagttgatatgattaatctcttcaattcaatggaaagagactgcattctacctgactgtcgtatcttcagcatactgattaatgcatatgctaaatctgggaagcttgataaggccatgcttatcttcaataaaatgcagaaacaaggagtgagtccaaatgcagtcacatattcaactgtaatagatgcattttgcaaaaagggtcaattggacgatgctatgataaagtttaatcagatgattgatacaggagtacgacagggcacagctgtttatggttctctaatccagggtttttgtacacactgcgatttggtgaaagcaaaggaattgcttactgaaatgatgaacaaaggcatgcttcctcctgatattgcattcttcaattcaatcatgcagaacctttgcacagaaggaagggtaatagaagcacgggatgtccttggcttgatagcgcacataggtgtgaggcctgatgtttgcacatttaatatactgatcggtggatactgcctagtcggcaagatggaacatgcctcaaaaatatttgatgatatgatgtcatatggcttagaaccttctaatattacgtatggtatacttattaatggctattgcaaaaatagaaggattgatgacgggcttattctgttcaaagagatgctgcacaagggacttaaacctacaacttttaattataacgtcatactggatggattatttctggctggacgaactgttgctgcaaaggaaaagtttgatgagatggttgaatctggagtaagtgtgtgcattggtacatattcgatagttcttggtggactttgtagaaataattgctttagcgaagcaatcatgctgttccagaaattaagggcaatgaacatgaaattcaatattagaattgtcaatatcatgattgatgccttctttagggttcagagaaagcaagaagctaaagatttgtttgccgcaataccagccaatggcttggtagctaatgttgttacctacagcataacgatgacaaatcttataaaagaaggttcagtggaagaagctaacactctctttttatcaatggagaagagtggctgtactgccaacgcttggatgttaaatcatactatcagaaggttactggaaagaggagagatagtcaaggctggaaattatatgtctaaagttgatgcaaagagctactcacttgaagctaaaactgtttcattgctgatctctctcttttctgggaaagggaaatatagagaacacataggattgctccctacaaagtatcagtttcgtgaagaagcggccacagttgaa

SEQ ID NO: 2104 - DNA, 1866 bp, Triticum aestivum; identical to SEQ ID NO: 2103

SEQ ID NO: 2105 - DNA, 1866 bp, Triticum aestivum
atgaggctctggacattctgcttcacaggatgcctgagcttggctgcacccctgacgtggtggcgtgacgtggtggcgtataacacggtcatccatggcttctttaaggaaggccaagtaggcaaggcatgcaatctgttccatggaatggcgcagcagggcgttgcgcctaatttggtgacatataactcggttattgatgcgttgtgcaaggccaaagcaatggacaaggcagagtatttccttggtcagatggttgatgatggtgtcgtacctgataatgtgacatataatagcctcatccatggatattcctcttcaggccactggaaggaggctgttagggtattcaaagagatgacaagtcggagggttaaaccaaatgtgcatactcacaacatgtttatgacctttctttgcaaacatggaagaagcaaagaagctgcaggaatttttgataccatggctatgaagggcctgaaacataacaacgtttcatatgctattctccttcacgggtatgccaccgaaggatgcttagttgatatgattaatctcttcaattcaatggaaagagactgcattctacctgactgtcgtatcttcagcatactgattaatgcatatgctaaatctgggaagcttgataaggccatgcttatcttcaataaaatgcagaaacaaggagtgagtccaaatgcagtcacatattcaactgtaatagatgcattttgcaaaaagggtcaattggacgatgctatgataaagtttaatcagatgattgatacaggagtacgacagggcacagctgtttatggttctctaatccagggtttttgtacacactgcgatttggtgaaagcaaaggaattgcttactgaaatgatgaacaaaggcatgcttcctcctgatattgcattcttcaattcaatcatgcagaacctttgcacagaaggaagggtaatagaagcacgggatgtccttggcttgatagcgcacataggtgtgaggcctgatgtttgcacatttaatatactgatcggtggatactgcctagtcggcaagatggaacatgcctcaaaaatatttgatgatatgatgtcatatggcttagaaccttctaatattacgtatggtatacttattaatggctattgcaaaaatagaaggattgatgacgggcttattctgttcaaagagatgctgcacaagggacttaaacctacaacttttaattataacgtcatactggatggattatttctggctggacgaactgttgctgcaaaggaaaagtttgatgagatggttgaatctggagtaagtgtgtgcattggtacatattcgatagttcttggtggactttgtagaaataattgctttagcgaagcaatcatgctgttccagaaattaagggcaatgaacatgaaattcaatattagaattgtcaatatcatgattgatgccttctttagggttcagagaaagcaagaagctaaagatttgtttgccgcaataccagccaatggcttggtagctaatgttgttacctacagcataacgatgacaaatcttataaaagaaggttcagtggaagaagctgacactctctttttatcaatggagaagagtggctgtactgccaacgcttggatgttaaatcatactatcagaaggttactggaaagaggagagatagtcaaggctggaaattatatgtctaaagttgatgcaaagagctactcacttgaagctaaaactgtttcattgctgatctctctcttttctgggaaagggaaatatagagaacacataggattgctccctacaaagtatcagtttcgtgaagaagcggccacagttgaa

SEQ ID NO: 2106 - DNA, 1866 bp, Triticum aestivum; identical to SEQ ID NO: 2105

SEQ ID NO: 2107 - DNA, 1866 bp, Triticum aestivum
atgaggctctggacattctgcttcacaggatgcctgagcttggctgcacccctgacgtggtggcgtgacgtggtggcatataacacggtcatccatggcttctttaaggaaggccaagtaggcaaggtatgcaatctgttccatggaatggcgcagcagggcgttgcgcctaatttggtgacatataactcggttattgatgcgttgtgcaaggccaaagcaatggacaaggcagagtatttccttggtcagatggttgatgatggtgtcgtacctgataatgtgacatataatagcctcatccatggatattcctcttcaggccactggaaggaggcagttagggtattcaaagagatgacaagtcggagggttacagcagatgtgcatactcacaacatgtttatggcctttctttgcaaacatggaagaagcaaagaagctgcaggaatttttgataccatggctatcaagggcctgaaacctgacaacgtttcatatgctattctccttcatgggtgtgccaccgaaggatgcttagttgatatgattaatctcttcaattcaatggcaacagactgtattctacctaactgccatatcttcaatatactgattaatgcatatgctaaatctgggaagcttgataaggctatgcttatcttcaatgtaatgcagaaacaaggagtgagtccagatggagtcacctattcaactgtaatacatgcattttgcaaaatgggtagcttggacattgctatggacaaatttaaccagatggttgatatgggagtacgaccgaatgcaattgtttatcattccctaatccagggtttttgtacacatggggatttagtgaaagcaaaggaattggttgctgaaatgaggaacaaagctatgcgtcctcctgatattaagttcttccattcaataatgcagaacctatgcacggaaggaagggtaatagaagcacgggatatcctcgacttgatagtgcgcattggtatgaggcctgatgttcccatctttaatttactgatcggtggatactgcctagtccgcaagatggcagatgcatcaaaaatatttgatgatatggtgtcatatggtttagaaccttcaaatattacgtatggtatacttattaatggctattgcaaaaatagaaggattgatgacgggcttattctgttcaaagagatgctgcccaagggacttaaacctacaacttttaattataacgtcatactggatggattatttctggctggacgaactgttgctgcaaaggaaaagtttgatgagatggttgaatctggagtaagtgtgtgcattggtacatattcgatagttcttggtggactttgtagaaataattgtagcggcgaagcaatcacgctattccagaaattaagcacaatggatgtgaaattcaatattataattgtcaatataatgattgatgctttctacaaggttcagcgaaaccaagaagccaaggatttgtttgctgcagtatcagccaatggtttggtagctaatgtctttacctacaccataatgatgaaaaatcttataaaagaagggtcagtggaagaagctgacgatctctttttatcaatggagaagagcggctgtactgctgactcttatatgttaaatcttatcgtcagaatgttactgggaaaaggagagatagtcaaggctgggaattatatatctaaaattgatgcaaagagctactcacttgaagctaaaactgtttcgctgcttatctctctcttttcagggaaagggaaatatagagaacacataggattgctccctgcaaagtatcggtttcgtgaagaagcagcyacagttgtg

SEQ ID NO: 2108 - DNA, 1866 bp, Triticum aestivum
atgaggctctggacattctgcttcacaggatgcctgagcttggctgcacccctgacgtggtggcgtgacgtggtggcatataacacggtcatccatggcttctttaaggaaggccaagtaggcaaggtatgcaatctgttccatggaatggcgcagcagggcgttgcgcctaatttggtgacatataactcggttattgatgcgttgtgcaaggccaaagcaatggacaaggcagagtatttccttggtcagatggttgatgatggtgtcgtacctgataatgtgacatataatagcctcatccatggatattcctcttcaggccactggaaggaggcagttagggtattcaaagagatgacaagtcggagggttacagcagatgtgcatactcacaacatgtttatggcctttctttgcaaacatggaagaagcaaagaagctgcaggaatttttgataccatggctatcaagggcctgaaacctgacaacgtttcatatgctattctccttcatgggtgtgccaccgaaggatgcttagttgatatgattaatctcttcaattcaatggcaacagactgtattctacctaactgccatatcttcaatatactgattaatgcatatgctaaatctgggaagcttgataaggctatgcttatcttcaatgtaatgcagaaacaaggagtgagtccagatggagtcacctattcaactgtaatacatgcattttgcaaaatgggtagcttggacattgctatggacaaatttaaccagatggttgatatgggagtacgaccgaatgcaattgtttatcattccctaatccagggtttttgtacacatggggatttagtgaaagcaaaggaattggttgctgaaatgaggaacaaagctatgcgtcctcctgatattaagttcttccattcaataatgcagaacctatgcacggaaggaagggtaatagaagcacgggatatcctcgacttgatagtgcgcattggtatgaggcctgatgttcccatctttaatttactgatcggtggatactgcctagtccgcaagatggcagatgcatcaaaaatatttgatgatatggtgtcatatggtttagaaccttcaaatattacgtatggtatacttattaatggctattgcaaaaatagaaggattgatgacgggcttattctgttcaaagagatgctgcccaagggacttaaacctacaacttttaattataacgtcatactggatggattatttctggctggacgaactgttgctgcaaaggaaaagtttgatgagatggttgaatctggagtaagtgtgtgcattggtacatattcgatagttcttggtggactttgtagaaataattgtagcggcgaagcaatcacgctattccagaaattaagcacaatggatgtgaaattcaatattataattgtcaatataatgattgatgctttctacaaggttcagcgaaaccaagaagccaaggatttgtttgctgcagtatcagccaatggtttggtagctaatgtctttacctacaccataatgatgaaaaatcttataaaagaagggtcagtggaagaagctgacgatctctttttatcaatggagaagagcggctgtactgctgactcttatatgttaaatcttatcgtcagaatgttactgggaaaaggagagatagtcaaggctgggaattatatatctaaaattgatgcaaagagctactcacttgaagctaaaactgtttcgctgcttatctctctcttttcagggaaagggaaatatagagaacacataggattgctccctgcaaagtatcggtttcgtgaagaagcagctacagttgtg

SEQ ID NO: 2109 - DNA, 1875 bp, Triticum aestivum
atgatctgtctccacaagcgaagcaaagctatacagtccagtccagtccagtacgcgcacagcgcccgtcccgcctccccacgccgatgtcccagcctccacctcctccgccgccgctcctcctccttcactcccacctcgccgccctcacgctcctggtctccgcacgccgcctttgccgctgccacagagagcgtccgcgccgggacgctcagcccacaagacgcacaccagctgttcgaccaattgctgcggcagtccactccggtccccgggcaagccctgaacggcttcctcgccggccttgcccgtgcgcgagacaccgacgcctgcagagacggcccctcccttgccctcacgctcttcaaccgcgtatacggagaagaagccggtccacgggtggcgccgcccacagtccacacctacaacatcctgatgaactgctgctgccgcgtgggtcgttcagacctagggcttgcctacttcagccgcctcctaaggaccggcctcaaagcgaacgaggtcaccgccagcaccgtcctcaagtgcctctgctgtgcaaaaccggcagatgaagctgtgaacgtgctgcttcataggatgtccgtcctcggctgtgtgcctaattccttctcatacaacatagttctaaagagcttatgtgacgacagcaggagcgagcaagcactcgatctgctccaggtgatggcaaaaggagatgattgccccccccccaacgttctgtcatatagcacgctcatccacggcttctttaaggaaggcgaagtaggcaaggcatgcaatctattccatgaaatgatgcggcaaggggttgtgcctgatgtggtgacgtatagctcgattatcgatgcattgtgcaaggctggagcaatggacaaagcagagttgttccttcggcagatggttgatagcggtgttccaccgaataaggtgacgtatactagcatgatccatggatattccactttggactggtggaaagaggcgactaaaatgttcagagaaatgacaagcaggggtcttataccagatattgtcagttggaactcgttcatggactccctttgcaagcatggaagaagcaaagaagctgctgaaattttcgattccatggctgccaagggccacagacctaatattgtctcctacactattcttcttcatgggtatgccaatgaaggaagctttgctgatatgatgagtctcttcaattcaatggaaggtgacggtattgtggccaactgctatgttttcaacatattaattaatgcatatgctaaacgaagaatgatggatgaagctgtgctcatacttactgaaatgcggggacaaggactgagtccagatgtattcacctattcaactctaatatctgcactttgcaaaatgggtaggctggctgatgctatggataagttcagtcagatgattggtacaggagtacaaccagacacagttgtttatcaatccctaattcagggtttctgtacacatggcgagttagtatatgaaatgatgaacaaaggtattccttgtccaaacattgcattcttcagttcaatagtagacagtctatgcaaagaaggaagggttatggatgcacaccatatctttgacttggttaaagacataggtgagagacctgacatcattatgtttaatacgctgattgacggatattgcctagtcggtgagatgggcaaagcattcatggtacttgatgtcatgacatcagctggcattgagcctgatgccattacgtatagtacacttgtcagtggatattgtaaaagtggaaggatcgatggtgggttgattctgttcagagaaatgttgcataagaaatgttacata

SEQ ID NO: 2110 - DNA, 1875 bp, Triticum aestivum; identical to SEQ ID NO: 2109

SEQ ID NO: 2111 - DNA, 1713 bp, Triticum aestivum
atgccccaactgggagttcaacctgatgtggtgacctacacctcaatcatggacgcactaagcaagtccggagcaatggacaaggcagaagtgctccttcggcaaatggttgatcaaggaattgaacccaatatcaggacatatagctgtctgatccatggatattctacttttggtcagtggaaggaggcacttagggtattcaaagaaatggcaagtcttggtgttgtaccagacgttgtcacgttgagctcattaatcgattccctttgcaggcacagaaggacaaagcaagctagagaaatttttgactctatggctgcaaagggcctgaaacctaatatcgtctcctactctactatgcttaatgggtatgtcaaagaaggatccttcgaggatatgactgatctcttcaattcgatggtacggaatggtattgtacctaaccaccatattttcaacatactgatcaatgcatatgctaaacgtggactgatggatgaggctatgcacatgttcgaagtaatgaggcaacaaggagtaaacccagatgtatttggctatcaaatcataatggattcactttgtaaaatgggtaagatggatgctgctctggacaaatttaatcagatggtcaatcaaggagtttcacctaacaaagctgtttaccaatgcctggttctgggttcttgctctcatggtgattttgtgaaagccaaggaattgatttctgaagcggttaatagaggtctgtgttctaacagtgtgttcttctatcctgtaataaacgacctttgcaaagaaggaaaggtaaaggaggcacatgatatgtttgacttcatcctaggtattggtcagcggcctgatgtgattatgtacacttcactgatggatggatattgccttgttggcaaggtggaggaagcactgagagtacttgatgctatgaagtctgctggcctccaacctgatgtttttacatatggtacacttcttaatggctactgtaaaattggaaggatcgccgatggattgagtcttttcagggaaatgtcactcagcggggttaagcccactactattatgtacaacattatacttgatgggctgtttcgctccgggagaacagattctgcaaaggaagaattcgatacaatgattgaaagtggcataccggtgggcattgacacatgcaccatagttcttagtggactttgcaaaaataattgcactgatgaagcaatagagctgttcaagaaattatgtgcaatgaatgtgaagtttgatgtcataatactcaataccatgatttcttcaatgtttaagactaggagaattgaagaagccaaggatttgtttgctactatatcaaccatagggttggtgccttctgttgtgacttacagtgtaatgatgacgaatttcataaaagaagggtcgctggcagaggctgatgatatgtttttagcaatggagaaggctagctgtgctcccaactccatcctgctaaatcaagtggtcagggcgttgctgaaaaaaggtgcagttgtgaaggctgcaacttatctcgctaaacttgatgctaaacagctgtcagttgaagcctcaacgatttcgttaatagtatttctcttctcaggggaagggaaactaagggagcacgtagagttgcttccagtaaagtaccagcctcctgagagttcggctgacagt

SEQ ID NO: 2112 - DNA, 1713 bp, Triticum aestivum; identical to SEQ ID NO: 2111

SEQ ID NO: 2113 - DNA, 1821 bp, Triticum aestivum
atggcaaaagatagaggtggctgcttccctgatgtggtggcatataacacggtcatccatggctttttcaaggagggtgaaacaggcaaggcatgcaatctatttcatgaaatgatccatcaaggggttgagcccgatgtggtgacgtacaactcggtcgttgatgcgttgtgcaaggccagggcaatggacaaagcagagctagtccttcgtcagatggttgctgatggtgctcaacccaatgcagtgacatataattgcatgattaatggatatgccacatctgggcggttgaaagaggctgctaaaatgttcagagaaatgaaaagccggggccttataccagatatttttacttgcaactccttaatgacttacctttgcaagcatggaagaagcaaagaagctgcagaatttttttattcgatgacagcaaagggccacaaaccggatatcgtctcatactgtattttgcttcatgggtatgctactgaaggatgctttcctgatatgattgatgtctttaattcaatggaaaacaatggtattgcagccgacttccatgttttcaacatattaattgatgcatatgctaaacgtggaatgatggatgaagctatgctgatatcaagtaaaatgcaggaacgcagagtgaatcctgatatagtcacctattccagcataatagctggactttccagattgggtaggctgactgaggccatggaaaaattcaatcagatgattgccttgggagtacaaccgaacaaagttgtttatcacgcgctgattcagggtttttgcatagatggtgatttggctaaagctaagcagttggtttctgaaatgatgaacagaggtattcctcgtcctaacatttcgttctttagttcactaataaagagtctctgccaagaaggaagggttatggatgcccatgatatctttgacttggttatagacatgggtgagaggcctgatgacattttatttaattcactgattgacggatactgcttagtcaggaagatggataaagcattaaaagtacttgatgtcatggaatcagttggtgttgagcctgatgttattacatacaatacacttgttaatggctattgtagaaatggaaggatcggtgatggtttgactctgttcagagagatgccgcgtaagagaattaaacctgacactaattcatattgcgtcataatggatgggttgtttcgttctgggagaactgtttctggaagggaaatgttccatgagatgatcgaaagtggaacaacagtcagcatttccacatacaacgtaatactaggaggtctttgtggaaataattgtgcagacgaagcgattgccctgttccagaaattaggttcaatgaatgtgaagttcagtattgcaatagtcaataccatgatcgatgcaatgtacagggttgggagaagagaagaagctaaggaactttttgctggaatatcagccagtgggttggtgcctaatgaatctacttatggagtaatgattatgaatcttctaaaagatggagcagtggaagatgctaacaatgtgttttcatcaatggacaagagtggtatagtccccagctctcgtctgttaaatgatattatcagaatgttgttggaaaaagatgagatcgccaaggccggaaattatttgtctaaagttgatgggaagagcatctccctagaagcttcaacaacttcattaatgttgtctctcttttcaagagaagggaaatatcgggaggacatgaaattgcttcctgcaaagtaccaatttttcgatggattttgt

SEQ ID NO: 2114 - DNA, 1821 bp, Triticum aestivum
atggcaaaagatagaggtggctgcttccctgatgtggtggcatataacacggtcatccatggctttttcaaggagggtgaaacaggcaaggcatgcaatctatttcatgaaatgatccatcaaggggttgagcccgatgtggtgacgtacaactcggtcgttgatgcgttgtgcaaggccagggcaatggacaaagcagagctagtccttcgtcagatggttgctgatggtgctcaacccaatgcagtgacatataattgcatgattaatggatatgccacatctgggcggttgaaagaggctgctaaaatgttcagagaaatgaaaagccggggccttataccagatatttttacttgcaactccttaatgacttacctttgcaagcatggaagaagcaaagaagctgcagaatttttttattcgatgacagcaaagggccacaaaccggatatcgtctcatactgtattttgcttcatgggtatgctactgaaggatgctttcctgatatgattgatgtctttaattcaatggaaaacaatggtattgcagccgacttccatgttttcaacatattaattgatgcatatgctaaacgtggaatgatggatgaagctatgctgatatcaagtaaaatgcaggaacgcagagtgaatcctgatatagtcacctattccagcataatagctggactttccagattgggtaggctgactgaggccatggaaaaattcaatcagatgattgccttgggagtacaaccgaacaaagttgtttatcacgcgctgattcagggtttttgcatagatggtgatttggctaaagctaagcagttggtttctgaaatgatgaacagaggtattcctcgtcctaacatttcgttctttagttcactaataaagagtctctgccaagaaggaagggttatggatgcccatgatatctttgacttggttatagacatgggtgagaggcctgatgacattttatttaattcactgattgacggatactgcttagtcaggaagatggataaagcattaaaagtacttgatgtcatggaatcagttggtgttgagcctgatgttattacatacaatacacttgttaatggctattgtagaaatggaaggatcggtgatggtttgactctgttcagagagatgccgcgtaagagaattaaacctgacactaattcatattgcgtcataatggatgggttgtttcgttctgggagaactgtttctggaagggaaatgttccatgagatgatcgaaagtggaacaacagtcagcatttccacatacaacgtaatactaggaggtctttgtggaaataattgtgcagacgaagcgattgccctgttccagaaattaggttcaatgaatgtgaagttcagtattgcaatagtcaataccatgatcgatgcaatgtacagggttgggagaagagaagaagctaaggaactttttgctggaatatcagccagtgggttggtgcctaatgaatctacttatggagtaatgattatgaatcttctaaaagatggagcagtggaagatgctaacaatgtgttttcatcaatggacaagagtggtatagtccccagctctcgtctgttaaatgatattatcagaatgttgttggaaaaaggtgagatcgccaaggccggaaattatttgtctaaagttgatgggaagagcatctccctagaagcttcaacaacttcattaatgttgtctctcttttcaagagaagggaaatatcgggaggacatgaaattgcttcctgcaaagtaccaatttttcgatggattttgt

SEQ ID NO: 2115 - DNA, 1821 bp, Triticum aestivum; identical to SEQ ID NO: 2114

SEQ ID NO: 2116 - DNA, 1821 bp, Triticum aestivum
atggcaaaagatagaggtggctgcttccctgatgtggtggcatataacacggtcatccatggctttttcaaggagggtgaaacaggcaaggcatgcaatctatttcatgaaatgatccatcaaggggttgagcccgatgtggtgacgtacaactcggtctttgatgcgttgtgcaaggccagggcaatggacaaagcagagctagtccttcgtcagatggttgctgatggtgctcaacccaatgcagtgacatataattgcatgattaatggatatgccacatctgggcggttgaaagaggctgctaaaatgttcagagaaatgaaaagccggggccttataccagatatttttacttgcaactccttaatgacttacctttgcaagcatggaagaagcaaagaagctgcagaatttttttattcgatgacagcaaagggccacaaaccggatatcgtctcatactgtattttgcttcatgggtatgctactgaaggatgctttcctgatatgattgatgtctttaattcaatggaaaacaatggtattgcagccgacttccatgttttcaacatattaattgatgcatatgctaaacgtggaatgatggatgaagctatgctgatatcaagtaaaatgcaggaacgcagagtgaatcctgatatagtcacctattccagcataatagctggactttccagattgggtaggctgactgaggccatggaaaaattcaatcagatgattgccttgggagtacaaccgaacaaagttgtttatcacgcgctgattcagggtttttgcatagatggtgatttggctaaagctaagcagttggtttctgaaatgatgaacagaggtattcctcgtcctaacatttcgttctttagttcactaataaagagtctctgccaagaaggaagggttatggatgcccatgatatctttgacttggttatagacatgggtgagaggcctgatgacattttatttaattcactgattgacggatactgcttagtcaggaagatggataaagcattaaaagtacttgatgtcatggaatcagttggtgttgagcctgatgttattacatacaatacacttgttaatggctattgtagaaatggaaggatcggtgatggtttgactctgttcagagagatgccgcgtaagagaattaaacctgacactaattcatattgcgtcataatggatgggttgtttcgttctgggagaactgtttctggaagggaaatgttccatgagatgatcgaaagtggaacaacagtcagcatttccacatacaacgtaatactaggaggtctttgtggaaataattgtgcagacgaagcgattgccctgttccagaaattaggttcaatgaatgtgaagttcagtattgcaatagtcaataccatgatcgatgcaatgtacagggttgggagaagagaagaagctaaggaactttttgctggaatatcagccagtgggttggtgcctaatgaatctacttatggagtaatgattatgaatcttctaaaagatggagcagtggaagatgctaacaatgtgttttcatcaatggacaagagtggtatagtccccagctctcgtctgttaaatgatattatcagaatgttgttggaaaaagatgagatcgccaaggccggaaattatttgtctaaagttgatgggaagagcatctccctagaagcttcaacaacttcattaatgttgtctctcttttcaagagaagggaaatatcgggaggacatgaaattgcttcctgcaaagtaccaatttttcgatggattttgt

SEQ ID NO: 2117 - DNA, 1821 bp, Triticum aestivum; identical to SEQ ID NO: 2116

SEQ ID NO: 2118 - DNA, 1821 bp, Triticum aestivum; identical to SEQ ID NO: 2116

SEQ ID NO: 2119 - DNA, 1701 bp, Triticum aestivum
atgatccatcaaggggttgagcctgatgtggtgacgtacaactcggtcgttgatgcattgtgcaaggccagagcaatggacaaggcagaagtagtccttcagcagatggtcgataaaggtgttcaacctaatatagtgacatatacttgcatgatcaatggatattccacaactgggcggttgaaagaggctgctaaaatgttcagagaaatgaaaagccgaggtcttataccagatattgttacttgcaactcattaatgacttccctttgcaagcatggaagaagcaaagaagctgcagaagttttttattcgatgacagcaaagggccacaaaccggatatcgtctcataccgtattttgcttcatgggtatgctactgaaggatgctttcctgatatgattgatgtctttaattcaatggaaaacaatggtattgcagccgactgccatgttttcaacatattaattgatgcatatactaaacgtggaatgatagatgaagctatgctgatatcaagtaaaatgcaggaacgcagagtgaatcccgatatagtcacctattccagcataatagctggactttccagattgggtaggctgactgaggccatggaaaaattcaatcagatgattgccttgggagtacaaccgaacaaagttgtttatcacgcgctgattcagggtttttgcatagatggtgatttggctaaagctaagcagttggtttctgaaatgatgaacaaaggtattcctcgtcctaacatttcgttctttagttcagtaataaagagtctctgccaagaaggaagggttatggatgcccatgatatctttgacttggttatagacatgggtgagaggcctgacgccattttatttaattcactgattgacggatactgcttagtcaggaagatggataaagcattaaaagtacttgatgtcatggaatcagttggtgttgagcctgatgttattacatacaatacacttgttaatggctattgtagaaatggaaggatcgatgatggtttgactctgtttagagagatgccgcgtaagagaattaaacctgacactatttcatattgcgtcataatggatgggttgtttcgttctgggagaactgtttctgcaagggaaatgttccatgagatgattgaaaatggaacgacagtcagcatttccacatacaacgtaatactaggaggtctttgtagaaataattgtgcagacgaagcgattgccctgttccagaaattaggttcaatgaatgtgaagttcagtattgcaatagtcaataccatgatcgatgcaatgtacagggttgggagaagagaagaagctaaggaactttttgctggaatatcagctcgtgggttggtgcctaatgtatctacttatggagtactgattatgaatcttctaaaagatggagcagtggaagatgctaacaatgtgttttcatcaatggacaagagtggtatagtccccagctcccgtctcatgaatgacatcatcagattgttgttggaaaaaggtgagatcgccaaggccggatattatttgtctaaagttgatgggaagagcatatcacttgaagcttcaactacttcattgatgttttctctcttctcaaggaaagggaaatatatgaaggacatgaatttgctccctgcaaagtatcaatttttcgat

SEQ ID NO: 2120 - DNA, 1335 bp, Triticum aestivum
atgatccatcaaggggttgagcctgatgtggtgacgtacaactcggtcgttgatgcattgtgcaaggccagagcaatggacaaggcagaagtagtccttcagcagatggtcgataaaggtgttcaacctaatatagtgacatatacttgcatgatcaatggatattccacatctgggcggttgaaagaggctgctaaaatgttcagagaaatgaaaagccgaggtcttataccagatattgttacttgcaactcattaatgacttccctttgcaagcatggaagaagcaaagaagctgcagaagttttttattcgatgacagcaaagggccacaaaccggatattgtctcataccgtattttgcttcatgggtatgctactgaaggatgctttcctgatatgattgatgtctttaattcaatggaaaacaatggtattgcagccgactgccatgttttcaacatattaattgatgcatatactaaacgtggaatgatagatgaagctatgctgatatcaagtaaaatgcaggaacgcagagtgaatcccgatatagtcacctattccagcataatagctggactttccagattgggtaggctgactgaggccatggaaaaattcaatcagatgattgccttgggagtacaaccgaacaaagttgtttatcacgcgctgattcagggtttttgcatagatggtgatttggctaaagctaagcagttggtttctgaaatgatgaacaaaggtattcctcgtcctaacatttcgttctttagttcagtaataaagagtctctgccaagaaggaagggttatggatgcccatgatatctttgacttggttatagacatgggtgagaggcctgacgccattttatttaattcactgattgacggatactgcttagtcaggaagatggataaagcattaaaagtacttgatgtcatggaatcagttggtgttgagcctgatgttattacatacaatacacttgttaatggctattgtagaaatggaaggatcgatgatggtttgactctgttcagagagatgccgcgtaagagaattaaacctgacactatttcatattgcgtcataatggatgggttgtttcgttctgggagaactgtttctgcaagggaaatgttccatgagatgattgaaaatggaacaacagtcagcatttccacatacaacgtaatactaggaggtctttgtagaaataattgtgcagacgaagcgattgccctgttccagaaattaggttcaatgaatgtgaagttcagtattgcaatagtcaataccatgatcgatgcaatgtacagggttggg

SEQ ID NO: 2121 - DNA, 1701 bp, Triticum aestivum
atgatccatcaaggggttgagcctgatgtggtgacgtacaactcggtcgttgatgcattgtgcaaggccagagcaatggacaaggcagaagtagtccttcagcagatggtcgataaaggtgttcaacctaatatagtgacatatacttgcatgatcaatggatattccacatctgggcggttgaaagaggctgctaaaatgttcagagaaatgaaaagccgaggtcttataccagatattgttacttgcaactcattaatgacttccctttgcaagcatggaagaagcaaagaagctgcagaagttttttattcgatgacagcaaagggccacaaaccggatattgtctcataccgtattttgcttcatgggtatgctactgaaggatgctttcctgatatgattgatgtctttaattcaatggaaaacaatggtattgcagccgactgccatgttttcaacatattaattgatgcatatactaaacgtggaatgatagatgaagctatgctgatatcaagtaaaatgcaggaacgcagagtgaatcccgatatagtcacctattccagcataatagctggactttccagattgggtaggctgactgaggccatggaaaaattcaatcagatgattgccttgggagtacaaccgaacaaagttgtttatcacgcgctgattcagggtttttgcatagatggtgatttggctaaagctaagcagttggtttctgaaatgatgaacaaaggtattcctcgtcctaacatttcgttctttagttcagtaataaagagtctctgccaagaaggaagggttatggatgcccatgatatctttgacttggttatagacatgggtgagaggcctgacgccattttatttaattcactgattgacggatactgcttagtcaggaagatggataaagcattaaaagtacttgatgtcatggaatcagttggtgttgagcctgatgttattacatacaatacacttgttaatggctattgtagaaatggaaggatcgatgatggtttgactctgttcagagagatgccgcgtaagagaattaaacctgacactatttcatattgcgtcataatggatgggttgtttcgttctgggagaactgtttctgcaagggaaatgttccatgagatgattgaaaatggaacaacagtcagcatttccacatacaacgtaatactaggaggtctttgtagaaataattgtgcagacgaagcgattgccctgttccagaaattaggttcaatgaatgtgaagttcagtattgcaatagtcaataccatgatcgatgcaatgtacagggttgggagaagagaagaagctaaggaactttttgctggaatatcagctcgtgggttggtgcctaatgtatctacttatggagtaatgattatgaatcttctaaaagatggagcagtggaagatgctaacaatgtattttcatcaatggacaagagtggtatagtccccagctcccgtctcatgaatgacatcatcagattgttgttggaaaaaggtgagatcgccaaggccggatattatttgtctaaagttgatgggaagagcatatcacttgaagcttcaactacttcatcgatgttttctctcttctcaaggaaagggaaatatatgaaggacatgaatttgctccctgcaaagtatcaatttttcgat

SEQ ID NO: 2122 - DNA, 1701 bp, Triticum aestivum; identical to SEQ ID NO: 2121

SEQ ID NO: 2123 - DNA, 1701 bp, Triticum aestivum
atgatccatcaaggggttgagcctgatgtggtgacgtacaactcggtcgttgatgcattgtgcaaggccagagcaatggacaaggcagaagtagtccttcagcagatggtcaataaaggtgttcaacctaatatagtgacatatacttgcatgatcaatggatattccacatctgggcggttgaaagaggctgctaaaatgttcagagaaatgaaaagccgaggtcttataccagatattgttacttgcaactcattaatgacttccctttgcaagcatggaagaagcaaagaagctgcagaagttttttattcgatgacagcaaagggccacaaaccggatattgtctcataccgtattttgcttcatgggtatgctactgaaggatgctttcctgatatgattgatgtctttaattcaatggaaaacaatggtattgcagccgactgccatgttttcaacatattaattgatgcatatactaaacgtggaatgatagatgaagctatgctgatatcaagtaaaatgcaggaacgcagagtgaatcccgatatagtcacctattccagcataatagctggactttccagattgggtaggctgactgaggccatggaaaaattcaatcagatgattgccttgggagtacaaccgaacaaagttgtttatcacgcgctgattcagggtttttgcatagatggtgatttggctaaagctaagcagttggtttctgaaatgatgaacaaaggtattcctcgtcctaacatttcgttctttagttcagtaataaagagtctctgccaagaaggaagggttatggatgcccatgatatctttgacttggttatagacatgggtgagaggcctgacgccattttatttaattcactgattgacggatactgcttagtcaggaagatggataaagcattaaaagtacttgatgtcatggaatcagttggtgttgagcctgatgttattacatacaatacacttgttaatggctattgtagaaatggaaggatcgatgatggtttgactctgttcagagagatgccgcgtaagagaattaaacctgacactatttcatattgcgtcataatggatgggttgtttcgttctgggagaactgtttctgcaagggaaatgttccatgagatgattgaaaatggaacaacagtcagcatttccacatacaacgtaatactaggaggtctttgtagaaataattgtgcagacaaagcgattgccctgttccagaaattaggttcaatgaatgtgaagttcagtattgcaatagtcaataccatgatcgatgcaatgtacagggttgggagaagagaagaagctaaggaactttttgctggaatatcagctcgtgggttggtgcctaatgtatctacttatggagtaatgattatgaatcttctaaaagatggagcagtggaagatgctaacaatgtattttcatcaatggacaagagtggtatagtccccagctcccgtctcatgaatgacatcatcagattgttgttggaaaaaggtgagatcgccaaggccggatattatttgtctaaagttgatgggaagagcatatcacttgaagcttcaactacttcatcgatgttttctctcttctcaaggaaagggaaatatatgaaggacatgaatttgctccctgcaaagtatcaatttttcgat

SEQ ID NO: 2124 - DNA, 1701 bp, Triticum aestivum; identical to SEQ ID NO: 2121

SEQ ID NO: 2125 - DNA, 1155 bp, Triticum aestivum
atgatgcagcaaggggttgtgcctgatgtggtgacgtataactcgattattgatgcgctgtgcaaggccagagctatgggcaaggcagagttgttcctagggcagatggttgataacagtgttcgaccagataacgtgacgtatactgcagtgatccatggatattccactttgggccagtggaaaaaggcgactaaaatgtttagagaaatgacaaggcgcggtcttgaaccaaatactgtcacttggaactcattcatggcctccctctgcaagcatggaagaagcaaagaagctgcagaaatttttcattccatggctgcgaagggccacaagcctgatgtcgtctcgtattgtgttctgctccaagggtatgctacagaagggtgctttgcagatatggttgatctctataattcaatggcaagaaatggtattgtacccaatcgccaggttttcaacatattaattgatgcatatgctaagcgtggaatgacggatgaagctacgcttatatttactgaaatgcggggacaaggactgagtccagatgtatgcacctattcaactcttatatctgcacttagcagaacgggtaggctggcggatgccatggatagattcagtcagatgatttctattggcatacaaccagacgcagttgtttatcaagctctaattcagggttattgtacagttggtgatttggtgaaagcaaagggattggtttctgaaatgatgaacagaggtattccccctaccgacattgtgttctttaattcaataatgagtagtctatgcaaagaaggaagggttacaaatgcacacagtatccttgacttcgttatacactttggtgagaggcctagcatcattacatttaatttgctgattgacgggtattgcttagttggcaagatgaagaaagctttcagagtacttgataccatggcatcagttggcattgggcctgatgatatttcatatagtgcaatcattaatggctgttttaaaaatggaaggatcgatgatggattgaccatattccgagaaatgctgaagaaagttacacctacaactgttacatataacatcatactgggcgggttattttgtgctgggcaaacagttgctgcacagaaaatgttcatgaga

SEQ ID NO: 2126 - DNA, 1155 bp, Triticum aestivum; identical to SEQ ID NO: 2125

SEQ ID NO: 2127 - DNA, 1707 bp, Triticum aestivum
atgatgcagcaaggggttgtgcctgatgtggtgacgtataactcgattattgatgcgctgtgcaaggccagagctatgggcaaggcagagttgttcctagggcagatggttgataacagtgttcgaccagataacgtgacgtatactgcagtgatccatggatattccactttgggccagtggaaaaaggcgactaaaatgtttagagaaatgacaagccgcggtcttgaaccaaatactgtcacttggaactcattcatggactccctctgcaagcatggaagaagcaaagaagctgcagaaatttttcattccatggctgcgaagggccacaagcctgatgtcgtctcgtatcgtgttctgctccaagggtatgctacagaagggtgctttgcagatatggttgatctctataattcaatggcaagaaatggtattgtacccaatcgccaggttttcaacatattaattgatgcatatgctaagcgtggaatgacggatgaagctacgcttatatttactgaaatgcggggacaaggactgagtccagatgtatgcacctattcaactcttatatctgcacttagcagaacgggtaggctggcggatgccatggatagattcagtcagatgatttctattggcatacaaccagacgcagttgtttatcaagctctaattcagggttattgtacagttggtgatttggtgaaagcaaagggattggtttctgaaatgatgaacagaggtattccccctaccgacattgtgttctttaattcaataatgagtagtctatgcaaagaaggaagggttacaaatgcacacagtatccttgacttcgttatacactttggtgagaggcctagcatcattacatttaattttctgattgacgggtattgcttagttggcaagatgaagaaagctttcggagtacttgataccatggcatcagttggcattgggcttgatgatatttcatatagtgcaatcattaatggctgttttaaaaatggaaggatcgatgatggattgaccatattccgagaaatgctgaagaaagttacacctacaactgttacatataacatcatactgggcgggttattttgtgctgggcaaacagttgctgcacagaaaatgttccatgagatgatcgaaagtggaataacagtgagcagttccacatacaggacaatccttggaggactttgcaggaatagttgtgaggacgaagcgatcaccctgttccagaaattaggagcaatgaatgtgaagttggatattgcaatactcaataccatgatcaatgcaatgttcaaggttcagagaagagaagaagctatcgatttgtttgctgcagtatcatccagtggattggtacctaatgcttctacctacggtgtaatgataaaaaatcttctaagagaaggatcagtggaaaaagctgaaaatatgttctcattaatggagaagagcggttgtgctccggactctcgtcttataaatgatatcatcagaatattattacagaaaggtgagattgtcaaggctggaaattatatgtctaaagttgatggcaggaggatctcacttgaagctagaactacttcattgctgatacgtctcttttcaagtgaagggaaatatcggggacaaataaatttgctccctgtaaagtaccaaaattttgatggatttagt

SEQ ID NO: 2128 - DNA, 1707 bp, Triticum aestivum; identical to SEQ ID NO: 2127

SEQ ID NO: 2129 - DNA, 1707 bp, Triticum aestivum; identical to SEQ ID NO: 2127

SEQ ID NO: 2130 - DNA, 1707 bp, Triticum aestivum
atgatgcagcaaggggttgtgcctgatgtggtgacgtataactcgattattgatgcgctgtgcaaggtcagagctatgggcaaggcagagttgttcctagggcagatggttgataacagtgttcgaccagataacgtgacgtatactgcagtgatccatggatattccactttgggccagtggaaaaaggcgactaaaatgtttagagaaatgacaagccgcggtcttgaaccaaatactgtcacttggaactcattcatggactccctctgcaagcatggaagaagcaaagaagctgcagaaatttttcattccatggctgcgaagggccacaagcctgatgtcgtctcgtatcgtgttctgctccaagggtatgctacagaagggtgctttgcagatatggttgatctctataattcaatggcaagaaatggtattgtacccaatcgccaggttttcaacatattaattgatgcatatgctaagcgtggaatgacggatgaagctacgcttatatttactgaaatgcggggacaaggactgagtccagatgtatgcacctattcaactcttatatctgcacttagcagaacgggtaggctggcggatgccatggatagattcagtcagatgatttctattggcatacaaccagacgcagttgtttatcaagctctaattcagggttattgtacagttggtgatttggtgaaagcaaagggattggtttctgaaatgatgaacagaggtattccccctaccgacattgtgttctttaattcaataatgagtagtctatgcaaagaaggaagggttacaaatgcacacagtatccttgacttcgttatacactttggtgagaggcctagcatcattacatttaattttctgattgacgggtattgcttagttggcaagatgaagaaagctttcggagtacttgataccatggcatcagttggcattgggcttgatgatatttcatatagtgcaatcattaatggctgttttaaaaatggaaggatcgatgatggattgaccatattccgagaaatgctgaagaaagttacacctacaactgttacatataacatcatactgggcgggttattttgtgctgggcaaacagttgctgcacagaaaatgttccatgagatgatcgaaagtggaataacagtgagcagttccacatacaggacaatccttggaggactttgcaggaatagttgtgaggacgaagcgatcaccctgttccagaaattaggagcaatgaatgtgaagttggatattgcaatactcaataccatgatcaatgcaatgttcaaggttcagagaagagaagaagctatcgatttgtttgctgcagtatcatccagtggattggtacctaatgcttctacctacggtgtaatgataaaaaatcttctaagagaaggatcagtggaaaaagctgaaaatatgttctcattaatggagaagagcggttgtgctccggactctcgtcttataaatgatatcatcagaatattattacagaaaggtgagattgtcaaggctggaaattatatgtctaaagttgatggcaggaggatctcacttgaagctagaactacttcattgctgatacgtctcttttcaagtgaagggaaatatcggggacaaataaatttgctccctgtaaagtaccaaaattttgatggatttagt

SEQ ID NO: 2131 - DNA, 1824 bp, Triticum aestivum
atgatggcgaaagaaggaggtggttgcttccccaacgtggtggcttataacacggtcatccatggcttccttaaggagggcaaaacaggcaaggcatgcaatctcttccatgaaatgatgcagctagggcttgtgcccgatgtggtgacatacaactcgatcgttgatgcgttgtgcaaggccagagcaatggacaaggcagaagtagtccttcatcagatgatcggtaaaggtgctcaacctgatacagtgacatataattgcatgatccatggatattccacatctgggcggttgaaagaggctgttaaaatgttcagagaaatgaaaagccggggtcttgcaccaaatattgttacttgcggctcgttaatgacttccctttgcaagcatggaagaagcaaagaagctagagaaatatttgattccatgactgccaaaggccacagagctaatgtcgtctcatactctattttgcttcatgggtatgccaatgaaggatgctttgctgatatgattgatctctttaattcaatgaaaagcaacggtattgcagctgactgccgtgtttttaccatattaattgatgcctatgctaaacgtggaatgatggatgatgcaatgcacatatttacggaaatgtgggaaaaaggagtgagtcccgatgtggttacctattccactgtaatagctgcactttccaggatgggtagattgaccgatgctatggacaaatttaatcagatgatttccatgggggttcaaccgaacacagttgtttatcacaccctaattcagggctcttgtatgcatggtgatttgattaaagccaaggagctggtttctgaaatgatgaacaaaggtattcctcgtcctagcattgcgttcttcggttcaataataaacaggttatgcaaagatggaagggttatggatgcacatgatatctttgacttggttatagacataggcgagaggcctagtgtcattacatttaattcactggttgacggatattgcttagtcggcaagatggataaagcatttggaatgcttaatgccatggaatcagttggtgttgagcctgatattgttacttacagtacacttcttgatggctattttaaaaatggaaggatcaatgatggtttgactctgtttagagaaatgccgcttaagagaattaaacctgacactgttacatatggcatcatgttggatgggtgttttcgtgctgggagaactgttgctgcaaggacaatgttccatgagatgatcgaaagtggaataacagtggacatccccacatataatatagttcttaggggactttgtagaaataactgcacagatgaagcaatcgccctgttccagaaattaggtgcaatgagtatgaagttcaatattgcaatactcaataccatgatcaatgcaatctacaaggttcggagaagagaagaagctaacaatttgtttgctgcaatatcagccagtgggttggtgcccaatcaatctacttatgctgtaatgataataaatcttctaaaagatggagcagtggaacatgctagcaatatgttttcatcaatggagaaaagtggtattgtccccagctcccgtcttataaatggtatcatcagattgttgttggagaatggtgagattgccaaggctggaatttatttgtctaaagttgatgggaatagcatctcacttgaagcttcaactacttcattgatgttgtctctgttttcaaggaaagggaaatatcaggaggacatgaagttgctccctgcaaagtatcaattttttggtgaatttggc

SEQ ID NO: 2132 - DNA, 1044 bp, Triticum aestivum
atgatggcgaaagaaggaggtggttgcttccccaacgtggtggcttataacacggtcatccatggcttccttaaggagggcaaaacaggcaaggcatgcaatctcttccatgaaatgatgcagctagggcttgtgcccgatgtggtgacatacaactcgatcgttgatgcgttgtgcaaggccagagcaatggacaaggcagaagtagtccttcatcagatgatcggtaaaggtgctcaacctgatacagtgacatataattgcatgatccatggatattccacatctgggcggttgaaagaggctgttaaaatgttcagagaaatgaaaagccggggtcttgcaccaaatattgttacttgcggctcgttaatgacttccctttgcaagcatggaagaagcaaagaagctagagaaatatttgattccatgactgccaaaggccacagagctaatgtcgtctcatactctattttgcttcatgggtatgccaatgaaggatgctttgctgatatgattgatctctttaattcaatgaaaagcaacggtattgcagctgactgccgtgtttttaccatattaattgatgcctatgctaaacgtggaatgatggatgatgcaatgcacatatttacggaaatgtgggaaaaaggagtgagtcccgatgtggttacctattccactgtaatagctgcactttccaggatgggtagattgaccgatgctatggacaaatttaatcagatgatttccatgggggttcaaccgaacacagttgtttatcacaccctaattcagggctcttgtatgcatggtgatttgattaaagccaaggagctggtttctgaaatgatgaacaaaggtattcctcgtcctagcattgcgttcttcggttcaataataaacaggttatgcaaagatggaagggttatggatgcacatgatatctttgacttggttatagacataggcgagaggcctagtgtcattacatttaaatgtaatgacactaggcctctttgcacatactgtttattactgaat

SEQ ID NO: 2133 - DNA, 1824 bp, Triticum aestivum; identical to SEQ ID NO: 2131

SEQ ID NO: 2134 - DNA, 1824 bp, Triticum aestivum; identical to SEQ ID NO: 2131

SEQ ID NO: 2135 - DNA, 795 bp, Triticum aestivum
atgtcatggaatcagttggtgttgagcctgatgttattacatataatacacttgttaatggctattgtaaaagtggaaggatcgatgatggtctcgttctattcagagaaatgccgagtaagagagttaaacctgactgttacatatggcatcatactggcagggttgtttcgtgcttggagaactattgctgcaaggacaatgttccatgagatgatcgaaagtggaataacagtggacatcgtcacatacaatataattcttacaggactctgtagaaataattgcatagatgaagcgatcgccctgttccagaaattaggtgtaatgagtgtgaagttcaatattgcaataataaataccatgatcgatgcaatgtacaaggttcggagaagagaagaagccagtgatttatttgctgcaatatcagccagtggattggtgcccaatgaatctacttatgcagtaatgataataaatcttctaaaagatggagcagtggaagaagcagacaatatgttttcatcaatggagaaaagtggtatagtccccagctcccgtctgttaaatcgtatcatcagaatgttgttggaaaaaggtgagactgccaaggccggaaattatttgtctaaagttgatgggaagggcatctcacttgaagcttcaacgacttcattaatgttgtctctcttttcaagagaagggaaatatcgggaggacgtgaaattgcttcctgcaaagtaccaattttttgatggatttgttgattttgcacaagactctgctcaggaagct

SEQ ID NO: 2136 - DNA, 1818 bp, Triticum aestivum
atgtgggcatataacacggtaatccatggcttctttaaggaaggcgaaacaggcaaggcgtgcaatctattccatgaaatggtacggcaagggattgtgcctgatgtggtgacatataactcgattattgacgcgttgtgcaaggccagggcaatggacaaggcagagttagtccttcagcagatggttgctgatggtgctcaacccaatgaagtgacatataattccatgatcaatggatatgcctcatctgggcgcttaaaagggactactaaaatgttcagagaaatgaaaaggcggggtcttataccagataattttacttgcaactcgttcctggcctccctgtgcaagcatggaagaagcaaagaagctgcagaattttttgattccatgacagccaagggccacaaacctgatatcgtctcgtactgtactttgcttcatgggtatgccagtgaaggatgctttgctgatatgattgatctttttaattcaatggaaagcaatgttattgcggccgactgccgtgttttcaccattttaattgttgcctatgctaaacgtggaatgatggatgaagctatgctggtatcaagtaaaatgcaggaacgcggagtgaatccgaatatattcacctattccagcataatagctggcctttccagaatgggtaggctgaccgaggccatggaaaaattcaatcagatgattgctttgggagtacaaccggacaaagttgtttatctgtctctgattcagggtttttgcttagatggtgatttggctaaagttaagcagttggtttctgaaatgatgaacagaggtattcctcattctggcattccgttcttcggttcagtaataaagaatctgtgccaagaaggaagggttatggatgcacatgaaatctttgacttggttatagacatgggtgagaggcctgatgacattttatttaattcactgattgatggatactgcttagtcgggaagatggataaagcattaaaagtacttgatgtcatggaatcagttggtgttgagcctgatgttattacatataatacacttgttaatggctattgtaaaagtggaaggatcgatgatggtctcgttctattcagagaaatgccgagtaagagagttaaacctgacactgttacatatggcatcatactggcagggttgtttcgtgcttggagaactattgctgcaaggacaatgttccatgagatgatcgaaagtggaataacagtggacatcgtcacatacaatataattcttacaggactctgtagaaataattgcatagatgaagcgatcgccctgttccagaaattaggtgtaatgagtgtgaagttcaatattgcaataataaataccatgatcgatgcaatgtacaaggttcggagaagagaagaagccggtgatttatttgctgcaatatcagccagtggattggtgcccaatgaatctacttatgcagtaatgataataaatcttctaaaagatggagcagtggaagaagcagacaatatgttttcatcaatggagaaaagtggtatagtccccagctcccgtctgttaaatcgtatcatcagaatgttgttggaaaaaggtgagactgccaaggccggaaattatttgtctaaagttgatgggaagggcatctcacttgaagcttcaacgacttcattaatgttgtctctcttttcaagagaagggaaatatcgggaggacgtgaaattgcttcctgcaaagtaccaatttttttatggatttgttgattttgcacaagactctgctcaggaagct

SEQ ID NO: 2137 - DNA, 1230 bp, Triticum aestivum
atgtgggcatataacacggtaatccatggcttctttaaggaaggagaaacaggcaaggcgtgcaatctattccatgaaatggtacggcaagggattgtgcctgatgtggtgacatataactcgattattgacgcgttgtgcaaggccagggcaatggacaaggcagagttagtccttcagcagatggttgctgatggtgctcaacccaatgaagtgacatataattccatgatcaatggatatgcctcatctgggcgcttaaaagggactactaaaatgttcagagaaatgaaaaggcggggtcttataccagataattttacttgcaactcgttcctggcctccctgtgcaagcatggaagaagcaaagaagctgcagaattttttgattccatgacagccaagggccacaaacctgatatcgtctcgtactgtactttgcttcatgggtatgccagtgaaggatgctttgctgatatgattgatctttttaattcaatggaaagcaatggtattgcggccgactgccgtgttttcaccattttaattgttgcctatgctaaacgtggaatgatggatgaagctatgctggtatcaagtaaaatgcaggaacgcggagtgaatccgaatatattcacctattccagcataatagctggcctttccagaatgggtaggctgaccgaggccatggaaaaattcaatcagatgattgctttgggagtacaaccggacaaagttgtttatctgtctctgattcagggtttttgcttagatggtgatttggctaaagttaagcagttggtttctgaaatgatgaacagaggtattcctcattctgacattccgttcttcggttcagtaataaagaatctgtgccaagaaggaagggttatggatgcacatgaaatctttgacttggttatagacatgggtgagaggcctgatgacattttatttaattcactgattgatggatactgcttagtcgggaagatggataaagcattaaaagtacttgatgtcatggaatcagttggtgttgagcctgatgttattacatataatacacttgttaatggctattgtaaaagtggaaggatcgatgatggtctcgttctattcagagaaatgccgagtaagagagttaaacctgactgttacatatggcatcatactggcagggttgtttcgtgcttggagaactattgctgcaaggacaatgttcca

SEQ ID NO: 2138 - DNA, 1818 bp, Triticum aestivum
atgtgggcatataacacggtaatccatggcttctttaaggaaggcgaaacaggcaaggcgtgcaatctattccatgaaatggtacggcaagggattgtgcctgatgtggtgacatataactcgattattgacgcgttgtgcaaggccagggcaatggacaaggcagagttagtccttcagcagatggttgctgatggtgctcaacccaatgaagtgacatataattccatgatcaatggatatgcctcatctgggcgcttaaaagggactactaaaatgttcagagaaatgaaaaggcggggtcttataccagataattttacttgcaactcgttcctggcctccctgtgcaagcatggaagaagcaaagaagctgcagaattttttgattccatgacagccaagggccacaaacctgatatcgtctcgtactgtactttgcttcatgggtatgccagtgaaggatgctttgctgatatgattgatctttttaattcaatggaaagcaatggtattgcggccgactgccgtgttttcaccattttaattgttgcctatgctaaacgtggaatgatggatgaagctatgctggtatcaagtaaaatgcaggaacgcggagtgaatccgaatatattcacctattccagcataatagctggcctttccagaatgggtaggctgaccgaggccatggaaaaattcaatcagatgattgctttgggagtacaaccggacaaagttgtttatctgtctctgattcagggtttttgcttagatggtgatttggctaaagttaagcagttggtttctgaaatgatgaacagaggtattcctcattctgacattccgttcttcggttcagtaataaagaatctgtgccaagaaggaagggttatggatgcacatgaaatctttgacttggttatagacatgggtgagaggcctgatgacattttatttaattcactgattgatggatactgcttagtcgggaagatggataaagcattaaaagtacttgatgtcatggaatcagttggtgttgagcctgatgttattacatataatacacttgttaatggctattgtaaaagtggaaggatcgatgatggtctcgttctattcagagaaatgccgagtaagagagttaaacctgacactgttacatatggcatcatactggcagggttgtttcgtgcttggagaactattgctgcaaggacaatgttccatgagatgatcgaaagtggaataacagtggacatcgtcacatacaatataattcttacaggactctgtagaaataattgcatagatgaagcgatcgccctgttccagaaattaggtgtaatgagtgggaagttcaatattgcaataataaataccatgatcgatgcaatgtacaaggttcggagaagagaagaagccagtgatttatttgctgcaatatcagccagtggattggtgcccaatgaatctacttatgcagtaatgataataaatcttctaaaagatggagcagtggaagaagcagacaatatgttttcatcaatggagaaaagtggtatagtccccagctcccgtctgttaaatcgtatcatcagaatgttgttggaaaaaggtgagactgccaaggccggaaattatttgtctaaagttgatgggaagggcatctcacttgaagcttcaacgacttcattaatgttgtctctcttttcaagagaagggaaatatcgggaggacgtgaaattgcttcctgcaaagtaccaattttttgatggatttgttgattttgcacaagactctgctcaggaagct

SEQ ID NO: 2139 - DNA, 1818 bp, Triticum aestivum; identical to SEQ ID NO: 2136

SEQ ID NO: 2140 - DNA, 1818 bp, Triticum aestivum; identical to SEQ ID NO: 2136

SEQ ID NO: 2141 - DNA, 1818 bp, Triticum aestivum
atgtgggcatataacacggtaatccatggcttctttaaggaaggcgaaacaggcaaggcgtgcaatctattccatgaaatggtacggcaagggattgtgcctgatgtggtgacatataactcgattattgacgcgttgtgcaaggccagggcaatggacaaggcagagttagtccttcagcagatggttgctgatggtgctcaacccaatgaagtgacatataattccatgatcaatggatatgcctcatctgggcgcttaaaagggactactaaaatgttcagagaaatgaaaaggcggggtcttataccagataattttacttgcaactcgttcctggcctccctgtgcaagcatggaagaagcaaagaagctgcagaattttttgattccatgacagccaagggccacaaacctgatatcgtctcgtactgtactttgcttcatgggtatgccagtgaaggatgctttgctgatatgattgatctttttaattcaatggaaagcaatggtattgcggccgactgccgtgttttcaccattttaattgttgcctatgctaaacgtggaatgatggatgaagctatgctggtatcaagtaaaatgcaggaacgcggagtgaatccgaatatattcacctattccagcataatagctggcctttccagaatgggtaggctgaccgaggccatggaaaaattcaatcagatgattgctttgggagtacaaccggacaaagttgtttatctgtctctggttcagggtttttgcttagatggtgatttggctaaagttaagcagttggtttctgaaatgatgaacagaggtattcctcattctgacattccgttcttcggttcagtaataaagaatctgtgccaagaaggaagggttatggatgcacatgaaatctttgacttggttatagacatgggtgagaggcctgatgacattttatttaattcactgattgatggatactgcttagtcgggaagatggataaagcattaaaagtacttgatgtcatggaatcagttggtgttgagcctgatgttattacatataatacacttgttaatggctattgtaaaagtggaaggatcgatgatggtctcgttctattcagagaaatgccgagtaagagagttaaacctgacactgttacatatggcatcatactggcagggttgtttcgtgcttggagaactattgctgcaaggacaatgttccatgagatgatcgaaagtggaataacagtggacatcgtcacatacaatataattcttacaggactctgtagaaataattgcatagatgaagcgatcgccctgttccagaaattaggtgtaatgagtgggaagttcaatattgcaataataaataccatgatcgatgcaatgtacaaggttcggagaagagaagaagccagtgatttatttgctgcaatatcagccagtggattggtgcccaatgaatctacttatgcagtaatgataataaatcttctaaaagatggagcagtggaagaagcagacaatatgttttcatcaatggagaaaagtggtatagtccccaggtcccgtctgttaaatcgtatcatcagaatgttgttggaaaaaggtgagactgccaaggccggaaattatttgtctaaagttgatgggaagggcatctcacttgaagcttcaacgacttcattaatgttgtctctcttttcaagagaagggaaatatcgggaggacgtgaaattgcttcctgcaaagtaccaattttttgatggatttgttgattttgcacaagactctgctcaggaagct

SEQ ID NO: 2142 - DNA, 1605 bp, Triticum aestivum
atgccccgtctccgcctccgtcgcttctccaccgcgccgatgttccacctcctccgccgcagctcctcctccaccaccacctcgccgccctcgcgttcctggtctccccacgccgcctttgccgccgccacggagcgcatccgcgccgggacgctcagccgggaagacgcgcaccacctgttcgacgaattgctacggcaggccacccccgtccccagccgctccctaaacggcttacttgccgctctcgcccgtgtgcccgcccccgccgcctgcatcagagatggtcccgctctcgcccttggcctcttcaaccgcgtctgccgggatgaagccggcgcgcgggtggcaccacccacagtcttcacttacggtatcctcatgcactgctgctgctgcgcacatcgcccggacctagggcttgccttattcggccgcttcctcaggacgggcctgaagacaaatgagatcattgccaccaccttcctcaagtgcctctgctacgcaaaacggacggatgaggctctgaacgtgctgcttcataggatgtccgagctcggctgtgtgcctgatgccatctcatacaacattgttctgaagagcttatgtgaagatagcatgagtcagcgggcgctcgacctcctccagatgatggcgaaagaaggaggtggctgctcccccaacgtggtggcgtatagcacagtcatccatggcttttttaaggaaggtgaaacaggcaaggcatgcaatctgttccatgaaatgatgcagcaagatgttgagcccaatgtgtggacatatagttcaatcattgatgcattgtgcaatgccagagcaatggacaaggcagagctagtgcttcagcagatggttaacaaaggtgttcaacccaataatgtgacatataattgcatgatccatggatattccacatctgggaggtggaaagaggctgctaaattgtttagagaaatgaaaagccggggccttataccagatacttctacttgcaacgccttaatgacttaccattgtaagcatggaagaagcaaagaagctgcagaattttttgatgccatgactgccaaaggccacagagatgtcatctcctactgtattttgcttcatgggtatgccaatgaaggatgctttgctgatatgattgatctctttaattcaatggaaagcaatggttttgtagccgactgccatgttttcaccatattaattgatgcatatgctaaacgtggaatgatggatgaagctatgctcatatttactgaaatgcgggaaaaaggagtgagtcccaatgtagtcacctattccactgtaatagccgcactttgcagattgggtaggctgtccgatgctatggacaggttcaatgagatgactgatatgggtgtacagccgaacacagctgtttatcactccctaattcagggtttttgtatgcatggtgatttggttaaagttaaggaatttgtttctgaaatgatgaacaaaggtattcctcgtcctgacattgcgttcttcacttcagtaattaactctttatgcaaagaaggaagggttatgaatgcacaagtatctttgacttggtta

SEQ ID NO: 2143 - DNA, 1605 bp, Triticum aestivum; identical to SEQ ID NO: 2142

SEQ ID NO: 2144 - DNA, 1605 bp, Triticum aestivum; identical to SEQ ID NO: 2142

SEQ ID NO: 2145 - DNA, 1557 bp, Triticum aestivum
atggcgactgcgtcgtttgaggagagaaccacctcgccgccctcgcgttcctggtctccccacgccgccattgccgccgccacggagcgcatccgcgccgggacgctcagccgggaagacgcgcaccacctgttcgacgaattgctacggcaggccacccccgtccccagccgctccctaaacggcttacttgccgctctcgcccgtgtgcccgcccccgccgcctgcatcagagatggtcccgctctcgcccttggcctcttcaaccgcgtctgccgggatgaagccggcgcgcgggtggcaccacccacagtcttcacttacggtatcctcatgcactgctgctgctgcgcacatcgcccggacctagggcttgccttattcggccgcttcctcaggacgggcctgaagacaaatgagatcattgccaccaccttcctcaagtgcctctgctacgcaaaacggacggatgaggctctgaacgtgctgcttcataggatgtccgagctcggctgtgtgcctgatgccatctcatacaacattgttctgaagagcttatgtgaagatagcatgagtcagcgggcgctcgacctcctccagatgatggcgaaagaaggaggtggctgctcccccaacgtggtggcgtatagcacagtcatccatggcttttttaaggaaggtgaaacaggcaaggcatgcaatctgttccatgaaatgatgcagcaagatgttgagcccaatgtgtggacatatagttcaatcattgatgcattgtgcaatgccagagcaatggacaaggcagagctagtgcttcagcagatggttaacaaaggtgttcaacccaataatgtgacatataattgcatgatccatggatattccacatctgggaggtggaaagaggctgctaaattgtttagagaaatgaaaagccggggccttataccagatacttctacttgcaacgccttaatgacttaccattgtaagcatggaagaagcaaagaagctgcagaattttttgatgccatgactgccaaaggccacagagatgtcatctcctactgtattttgcttcatgggtatgccaatgaaggatgctttgctgatatgattgatctctttaattcaatggaaagcaatggttttgtagccgactgccatgttttcaccatattaattgatgcatatgctaaacgtggaatgatggatgaagctatgctcatatttactgaaatgcgggaaaaaggagtgagtcccaatgtagtcacctattccactgtaatagccgcactttgcagattgggtaggctgtccgatgctatggacaggttcaatgagatgactgatatgggtgtacagccgaacacagctgtttatcactccctaattcagggtttttgtatgcatggtgatttggttaaagttaaggaatttgtttctgaaatgatgaacaaaggtattcctcgtcctgacattgcgttcttcacttcagtaattaactctttatgcaaagaaggaagggttatgaatgcacaagtatctttgacttggtta

SEQ ID NO: 2146 - DNA, 1788 bp, Triticum aestivum
atgtggtggcatatagcagtcatccatggctttttcaaggaaggcgaaacaagcaaggcatgcaatctgttccatgaaatgatgcagcaaggtgttgagcccagtgtgtggacatatagttcaatcattgatgcattgtgcaaggccagagcaatggacaaggcagagctagtgcttcagcagatggttaacaaaggtgttcaacccaataatgtcacatataattgcatgatccatggatattccacatctgggaggtggaaagaggctgctaaattgtttagagaaatgaaaagccagggccttatacctgatacttttacttgcaacgccttaatgacttacctttgtaagcatggaagaagcaaagaaggtgcagaaatttctgatgccatgactgccaaaggccacaaaccggatatcgtctcatacagtattttgcttcatgggtatgccaatgaaggatgctttgctgatatgattgatctctttaattcaatggaaaggaatggcattgcagccgactgccatgttttcagcatattaattaatggatatgctaaatgtggaatgacggatgaagctatgctgatatttacagaaatgtgggaaaaaggagtgagtcccgatgtagtcacctattccactgtaatagctgcactttccagaatggggaggttgaccgacgctatggaaaaatttaatcagatgattgccatgggaattcaaccgaacacagccatttatcactccctaattcagggtttttgcatagacggtgatttggttaaagccaagcagctggtttctgaaatgatgaacagaggtattcctcggcctaacattgtgttcttcaatttagtaataaacagtctgtgcaaagaaggaagggttatggatgcacatgatgtcttagacttggttataggcataggtgagaggcctaatgtcattacatttaattcactgattgacggatattgcttagtcgggaagatggataaagcattcaaaatacttgatgtcatgaaatcagttggtgttgagtctgatgttgttacttatagtgcacttcttgatggctattctaaaaatagaaggattgatgatgctttgactttgtttagagaaatgccgcataagagaattaaatctgacactgttacatatggcatcgtgttggatgggttgtttcatgctgggagaactgttgctgcaatgaaaatgttccatgagatgatcaaaagtggaacaacagtgagtatttacacatacagtataatacttggaggtctttgtagaaataattgtgtagacgatgcgattgcactgttccagaaattacgatcaatgaatgtaaagttcaatattgaaatactcaataccatgattaatgcaatgtacaaggttcaaagaaaagaagaagctaaggatttgtttactacaatatcagccaatgggttggtgcccagtgaatctacttatgcagtaatgataagaaatcttctgaaagacggagcagtggaagatgctgacaatatgttttcatcaatggacaacagtggtatcgttcccagttcccatcttataaatgatatcatcagaatgttgttggaaaaaggtgagatagccaaggctggaaattatttgtctaaagttgatgggaagagtatctcacttgaagcttcaactacctcattgatgttgtctctcttttcaaggaaagggaaacatcaggaggatattaagttgctccctgcaaagtatcaaatttttgatggatttagt

SEQ ID NO: 2147 - DNA, 1758 bp, Triticum aestivum
atgtccaacctccgcctcctccgccgcagctcctcctccatgtccaccaccacgtcgccgccctcgcgctcctggtccccccattcggcctttgccgcggccacagagcgcgtgcgcgccaggacgctcagccaagacgatgcacaccacctgttcgacgaattgctgcggcaggccaccccggtccacgagcgctccctcaacggcttcctcgccgccctcgcgcgtgctacgtcctctgccgcttgcatcagagatggtcccgccctcgccatcgccctcttcaatcgcgtgtgccgagaacaagccggcccgcgggtggcgcctctcacagtccacacctacggcatcctcatggaatgttgttgtcgggcgggtcacccggaactagggcttgccatattcagccgtcttctcaggacggggctcaagacaaacgagatagtcggcagcaccttcctcaagtgcctctcctacgcaaaacggacggatgaggctctgaatgtgttgcttcataggatgcccgagctcggctgtgtgcctaatgccttctcatactccattgttctgaagagcttatgcaacaatagcatgagtcagcgggcgctcgacctgctccagaggatggcgaaagaaggaggtggctgcttccttaatgtggtgacacatagcacggtcatccatggcttctttaaggaaggtgaaataggcaaggcatgcactctgttccatgaaatgatgcagcaaggtgttgtgcccaatgtgtggacgtataactcgattattgatgcattgtgcaaggccagagcaatggacaaggcagagctagtccttcgtcagatggttgctaaaggtgctcaacccgatacagtgacatataattgcttgatcaatggatatgccacatctgggcggttgaaagaggctgctaaaatgttcagagaaatgaaaagccggggtcttacaccaaatattgttacctgcggctcgttaacgacttccctttgcaagcatggaagaagcaaagaagctagagaaatatttgattccatgacttccaaaggccacagagctaatgtcgtctcatactctattttgcttcatgggtatgccaatgaaggatgctttgctgatatgatttatctctttaattcaatgaaaagcaacggtattgcagccgactgccgtgttttcaacatattaattaatggatatgctaaacgtggaatgatggatgaagctgtgctgatatttactgaaatgcgggaaaaaggagtgagtcctgatgtagtcacctataccactgtaatagccgcactttccagaatgggtaggttgaccgatgctgtggacgaattcgatgagatgattgcaatgggagtacagccaagcatacctgtttatcagtccctgattcagggtttttgcatcgatggtgatttggttaaagccaaggagctggtttctgaaatgatgaacaaaggtattccttgtcctaacattgtgttcttcaattcagtaataaacagtctgtgcaaagaagaaagggttatggatgcacatgatatctttgacttggttatagacataggtgagaggcctgataccattacatttagttcactgattgacggatattgcttagtcggcaagatggataaagcattcggaatgcttaatgccatggaattagttggtgttgagcctgattgtaacgccttcgatgcggctatatctcccacgtgtcgaagcacgact

SEQ ID NO: 2148 - DNA, 1752 bp, Triticum aestivum
atgagccgccgctttgtccccgtcggcagacacatcttagagcagaacatcaaggctcggtaccatgctggagacattggcaccgaggacgcactccacctgtttgacgaattgctccaggttgctgggcgctcctcgatccatgccatcaactgcctcctcaccgttgtcggccgtgattgccctgcgctcggcgtctccctcttcaaccgtgtcgcaaggtccaaggtggcaccctgcagtatcacctatgccattctggtcgactgctgctgccgcgctggccgccaggaccttggacacactgccatgggacacgtcatcaagatgggatttcttgcagatgctattatcactttcagccacctactaaaggccatctgtgcagagaacaagaccagctatgcaatggacatcgtactccaggaaatggacatctcgtccatttttgatcggattttccaggaaatgtctagaaatggtgttcaaccagatattgtaacttacactatacagatggattatctttgcaagagcggaagatgcacagaagctaggaagatttttgattctatgatcagtttgggccaaaaaccgaccgttactacctacagcattctgcttcatgggtatgctatggaaaaatcttttcatgatatgctttgtctcattgatttgatggtaggtaatggtattgtaccagatcattatgtctacaacatactcatatctgcatatgctaaagaagaaatggttggtgaggtaatgcatatatttacaaaaatgcggcagcaaggattgaaccctgatgcagtgagctacggaacagtaatagacttactttccaggattggccgaatggatgatgctatgtccctattcaatcaaatgataactgaaggattagctcctggtatcatagttttcaaccaccttattagtggtttttgtacttgtggcaaatgggagaaggttcatgaactattttctgaaatgttggattgcggcatctgtccagacacagtgttcttcaacacagttatggatcgcctttgcaaaaatggaagggttacggaagcccaggatctctttgacctgatggtacacatgggtgtgaagcctgacgtgtgtacttataacacactgatgggtggatacttgttcgttggtaagatggatgaagtgagcaagttacttgacaatatggtctcaattggcatggaaccagatgttatcacctataacatactgattgatggttactctaagaatggaaggatagatgatgcattggttgttttcagggaaatgttggacacgaagggtaagccgtctgttatcagttttaatattatgattggtgcattgcttaaatgtggtaggaaggcagaagccaaagatttgtttgacggtatctgggccaacggattagtgcctgacattgttacatatagcttaatgatacaaaaactaatagaagaaggttctctacaagagtctgatgatctattcgtttctatggagaagaatgggtgtgctgccaactcccgtatgctaaatgctatagttagaagcttacttcagaagggggaggtgcccagggctgggacttatctgtctaaaattgatgagaggagcttcatccttgaagcttccacagctagcttgttgactgcacttgcgtcaagggggaaaggccaggaatataaggagttactccccgaaaaatactctgaactgctaatcgaggcc

SEQ ID NO: 2149 - DNA, 1752 bp, Triticum aestivum; identical to SEQ ID NO: 2148

SEQ ID NO: 2150 - DNA, 1752 bp, Triticum aestivum; identical to SEQ ID NO: 2148

SEQ ID NO: 2151 - DNA, 1635 bp, Triticum aestivum
atgagccgccgctttccccctgtcggcagacgcatcttggagaggagaattgaagaacggtacagcgccagagacattggcactgacgacacactcaacctgttcgacgaattgatccaggttgctgggccttcctcggtccgcgcaatcaactgcctcctcaccgtcgtcggccgtgattgccccgcactcggcgtctccctcttcaaccgtgttgcaagagccaaggtgcctccacacaatatcacctatggcattctagtcgactgctgctgccgtgctggccgcttggaccttggacacgctgccatgggacacgtcattaagttgggatttacagcagaagctatcgtcaatttcagccacctactcaaggccatctgtgcagtgaagaagaccagctatgcaatggacatcgtactccgagtaatgcctgagtttaactgcacaccgaacattttctcctacagcattcttttcaagggtctttgcaatgaaaggagaagccaagaggctcttgagctgattaatattatggttgaggatggaggtagctgccaacctgatgtggtgacctataacactgtaattgatggcttgttgaaagagggtgaggtggaccaagcttacagcctattttctgaaatgctgcgtcagggggtatcaccgaatgttgtgacatgtaattcaatcatctctggcatgtgcaagcttcacgcgatggacaaggctgaggaggttcttcaacagatgcttgatagacgaattctgccagatgttgccacatataatagtctgatacatggatattattcattaggacagtgcgaagaggtggatcggattttcaaggagatgactacaaatggtgttcaaccagatgttgtaacttacaatatacagatggattatctttgcaagaatggaagatgcgcagaagctaggaagatttttgattccatgatcagtttgggccaaaaacctactgttactacctacaacattctgcttcatgggtatgctatggaaagatcttttcatgatatgaattgtctcattgagttgatggatgataatggtatttcaccagatcattatggctacaacatactcatatctgcttatgctaaagaaaaaatggttgatgatgtattgcatatatttacaaaaatgcggcagcaaggattgaaccctgatgttgcgaactatggagcggtaataaacttgctttctagtattggccgaatggatgatgctatgtcccaatacaatcaaatgataaatgaagggttagctcctgatatcatagttttcaactcccttattagtggtttctgttcttgtggcaaatgggagaaggttcatgaactattttctgagatgttggatcgcggcatctgtcccaacacagtgttcttcaccactattatggaccrcctttgcaaaaatggaagggttatagaagcccaagatgtgttcgacctgatggtacacatgggtgtgaagcctgacgtgcgtagtcatgtcacactgatgcatggatactttgcagatggtaagatggatgaaatgaggaagttacttgaaaatatgtgctcaattggcttgaaactgatgttgtcacctatagcatac

SEQ ID NO: 2152 - DNA, 1533 bp, Triticum aestivum
atgagccgccgctttccccctgtcggcagacgcatcttggagaggagaattgaagaacggtacagcgccagagacattggcactgacgacacactcaacctgttcgacgaattgatccaggttgctgggccttcctcggtccgcgcaatcaactgcctcctcaccgtcgtcggccgtgattgccccgcactcggcgtctccctcttcaaccgtgttgcaagagccaaggtgcctccacacaatatcacctatggcattctagtcgactgctgctgccgtgctggccgcttggaccttggacacgctgccatgggacacgtcattaagttgggatttacagcagaagctatcgtcaatttcagccacctactcaaggccatctgtgcagtgaagaagaccagctatgcaatggacatcgtactccgagtaatgcctgagtttaactgcacaccgaacattttctcctacagcattcttttcaagggtctttgcaatgaaaggagaagccaagaggctcttgagctgattaatattatggttgaggatggaggtagctgccaacctgatgtggtgacctataacactgtaattgatggcttgttgaaagagggtgaggtggaccaagcttacagcctattttctgaaatgctgcgtcagggggtatcaccgaatgttgtgacatgtaattcaatcatctctggcatgtgcaagcttcacgcgatggacaaggctgaggaggttcttcaacagatgcttgatagacgaattctgccagatgttgccacatataatagtctgatacatggatattattcattaggacagtgcgaagaggtggatcggattttcaaggagatgactacaaatggtgttcaaccagatgttgtaacttacaatatacagatggattatctttgcaagaatggaagatgcgcagaagctaggaagatttttgattccatgatcagtttgggccaaaaacctactgttactacctacaacattctgcttcatgggtatgctatggaaagatcttttcatgatatgaattgtctcattgagttgatggatgataatggtatttcaccagatcattatggctacaacatactcatatctgcttatgctaaagaaaaaatggttgatgatgtattgcatatatttacaaaaatgcggcagcaaggattgaaccctgatgttgcgaactatggagcggtaataaacttgctttctagtattggccgaatggatgatgctatgtcccaatacaatcaaatgataaatgaagggttagctcctgatatcatagttttcaactcccttattagtggtttctgttcttgtggcaaatgggagaaggttcatgaactattttctgagatgttggatcgcggcatctgtcccaacacagtgttcttcaccactattatggaccgcctttgcaaaaatggaagggttatggaagcccaagatctcttccaggcagatcgccggcggcgaccaggcaatgttagccaggttgaaggagatcct

SEQ ID NO: 2153 - DNA, 1779 bp, Triticum aestivum
atggtgagcatcggcgagcatgctcgtcctcctaactctgctttccttcttcctaatcccagttcatgcccaggttgcgccggtgcggtggggggcgagcggcgccggcgtcctctgggtcctctgccattaccagattcttccagatccataagtggagctatgagccgccgcgccgttcccgctggcaggcgcatcttggagcagaacatcaaggcccggtaccgggctggagccattggcaccgacgatgcactccacctgtttgacgaattgctccaggttgcctggccctcctcgatcgccgccatcaactgcctcctcattgtcgtcggccgtgattgccctgtgctcgccgtctccctcttcaaccacatcgcaagagccaaggtggcgccccacaatatcacctacggcattctagtcgactgctgcagccgtgctggccgcttggaccttggcttcgctgccatgggccacatcgttaagatgggatttgtggcaagatccgttgtctctttcagccacctgctcagggccgtctgtgcgaagaagaagaccagctacagaatggacatcatgctccaaattatgcctgagcttaactgcataccggatgtttactcctacagcattcttttcaagggcctctgcaatgagaagagaagccaagaggctctcgagctgattcacgtgatggttgagcacggaggtagctgccaacctaatctggtctcatacaacaccgtaattgatggcttgttgaaagagggtgaggtgggcaaggcttacagcctattttgtgaaatggtacagagcgggattttggcaaatattgtgacatacaactcaatcatctctggcatgtgcaaggttcatgcaatggacaaggctgagaaggttcttcaacagatgtttgatagagaaattctgccagatactgccacatatactaccctaatacgtggatattattcatcaggacaatgcaaagaggtggaacgggttttcgagcacatgtctataaatggtgttcaaccaaatatgataacttgcaatatacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgctctccagtattggcagaatggatgatgctatgtcccaattcaatcaaatgatagccgaaggattagctcctgatatcatagttttcaacccccttattagtggtttttgtacttgtggcaaatgggagaagkttcatgaactattttctgaaatgttgaatcgcggcacctatcatgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatatactctcaattggctcgaaaccggat

SEQ ID NO: 2154 - DNA, 1779 bp, Triticum aestivum
atggtgagcatcggcgagcatgctcgtcctcctaactctgctttccttcttcctaatcccagttcatgcccaggttgcgccggtgcggtggggggcgagcggcgccggcgtcctctgggtcctctgccattaccagattcttccagatccataagtggagctatgagccgccgcgccgttcccgctggcaggcgcatcttggagcagaacatcaaggcccggtaccgggctggagccattggcaccgacgatgcactccacctgtttgacgaattgctccaggttgcctggccctcctcgatcgccgccatcaactgcctcctcattgtcgtcggccgtgattgccctgtgctcgccgtctccctcttcaaccacatcgcaagagccaaggtggcgccccacaatatcacctacggcattctagtcgactgctgcagccgtgctggccgcttggaccttggcttcgctgccatgggccacatcgttaagatgggatttgtggcaagatccgttgtctctttcagccacctgctcagggccgtctgtgcgaagaagaagaccagctacagaatggacatcatgctccaaattatgcctgagcttaactgcataccggatgtttactcctacagcattcttttcaagggcctctgcaatgagaagagaagccaagaggctctcgagctgattcacgtgatggttgagcacggaggtagctgccaacctaatctggtctcatacaacaccgtaattgatggcttgttgaaagagggtgaggtgggcaaggcttacagcctattttgtgaaatggtacagagcgggattttggcaaatattgtgacatacaactcaatcatctctggcatgtgcaaggttcatgcaatggacaaggctgagaaggttcttcaacagatgtttgatagagaaattctgccagatactgccacatatactaccctaatacgtggatattattcatcaggacaatgcaaagaggtggaacgggttttcgagcacatgtctataaatggtgttcaaccaaatatgataacttgcaatatacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgctctccagtattggcagaatggatgatgctatgtcccaattcaatcaaatgatagccgaaggattagctcctgatatcatagttttcaacccccttattagtggtttttgtacttgtggcaaatgggagaagtttcatgaactattttctgaaatgttgaatcgcggcacctatcatgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatatactctcaattggctcgaaaccggat

SEQ ID NO: 2155 - DNA, 1779 bp, Triticum aestivum; identical to SEQ ID NO: 2154

SEQ ID NO: 2156 - DNA, 762 bp, Triticum aestivum
atgtctataaatggtgttcaaccaaatatgataacttacaatatacagatggattatctttgcaagagcggaagatgcgcggaagctaggaagatctttgattctatggtcagtttgggccaaaaaccgtytgttactacmtacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggcaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatatgctctcaattggctcgaaaccggat

SEQ ID NO: 2157 - DNA, 1779 bp, Triticum aestivum; identical to SEQ ID NO: 2154

SEQ ID NO: 2158 - DNA, 1779 bp, Triticum aestivum
atggtgagcatcggcgagcatgctcgtcctcctaactctgctttccttcttcctaatcccagttcatgcctaggttgcgtcggtgcggtggggggcgagcggcaccggcgtcctctgggtcctctgcgattaccagattcttccagatccataggtggagctatgagccgccgcaccgtccccgctggcaggcgcatcttggagcagaacatcaaggcccggtaccgggctggagccattggcaccgacgatgcactccacctgtttgacgaattgctccaggttgcctggccctcctcgatcgccgccatcaactgcctcctcattgtcgtcggccgtgattgccctgcgctcgccgtctccctcttcaaccacatcgcaagagccaaggtggcgccccacaatatcacctacggcattctagtcgactgctgcagccatgctggccgcttggaccttggcttcgctgccatgggccacatcgttaagacggtatttgcggcaggatccattgtctctttcagccacctgctcagggccgtctgtgcggagaagaagaccagctacggaatggacatcgtgctccgaattatgcctgagcttaactgcataccggatgtttactcctacagcatgcttttcaagggcctctgcaacgagaagagaagccaagaggctctcgagatgattcacgtgatggttgagcacggaggtagctgccaacctaatctggtctcatacaacgccgtaattgatggcttgttgaaagagggtgaggtgggcaaggcttacatcctattttgtgaaatggtacagagcgggattttggcaaatattgtgacctacaactcaattatctctggcatgtgcaaggttcatgcaatggacaaggctgagaaggttcttcaacagatgtttgatagagaaattctgccagatactgccacatatactagcctaatacatggatgttattcatcaggacaatgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgcattccagtattggcagaatggatgatgctatgccccaattcaatcaaatgatagccgaaggattagctcctgatatcatagttttcaacccccttattagtggtttttgtacttgtggcaaatgggagaaggttcatgaactattttctgaaatgttgaatcgcggcacctatcatgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatatgctctcaattggctcgaaaccggat

SEQ ID NO: 2159 - DNA, 1779 bp, Triticum aestivum
atggtgagcatcggcgagcatgctcgtcctcctaactctgctttccttcttcctaatcccagttcatgcccaggttgcgtcggtgcggtggggggcgagcggcaccggcgtcctctgggtcctctgccattaccagattcttccagatccataggtggagctatgagccgccgcgccgtccccgctggcaggcgcatcttggagcagaacatcaaggcccggtaccgggctggagccattggcaccgacgatgcactccacctgtttgacgaattgctccaggttgcctggccctcctcgatcgccgccatcaactgcctcctcattgtcgtcggccgtgattgccctgcgctcgccgtctccctcttcaaccacatcgcaagagccaaggtggcgccccacaatatcacctacggcattctagtcgactgctgcagccgtgctggccgcttggaccttggcttcgctgccatgggccacatcgttaagacgggatttgcggcaggatccgttgtctctttcagccacctgctcagggccgtctgtgcggagaagaagaccagctacggaatggacatcgtgctccgaattatgcctgagcttaactgcataccggatgtttactcctacagcattcttttcaagggcctctgcaacgagaagagaagccaagaggctctcgagctgattcacgtgatggttgagcacggaggtagctgccaacctaatctggtctcatacaacaccgtaattgatggcttgttgaaagagggtgaggtgggcaaggcttacagcctattttgtgaaatggtacagagcgggattttggcaaatattgtgacctacaactcaatcatctctggcatgtgcaaggttcatgcaatggacaaggctgagaaggttcttcaacagatgtttgatagagaaattctaccagatactgccacatatactagcctaatacatggatattattcatcaggacaatgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgattttatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggcaaatgggagaaggttcatgaactattttctgaaatgttgaatcgcggcacctatcatgataccgtgttcttcaccacaattatggaccgcctttgcaaaaatggaagggttatggaatcccaagatatgtttgacctgatggtacacgtgggtgttaagcctaatgttcatacttatgccacattgatgcatgggtactttttcgttaggaagatggatgaagtgaggaagttagttggcaatatgctctcaattggctcgaaaccggat

SEQ ID NO: 2160 - DNA, 1779 bp, Triticum aestivum
atggtgagcatcggcgagcatgctcgtcctcctaactctgctttccttcttcctaatcccagttcatgcctaggttgcgtcggtgcggtggggggcgagcggcaccggcgtcctctgggtcctctgcgattaccagattcttccagatccataggtggagctatgagccgccgcgccgtccccgctggcaggcgcatcttggagcagaacatcaaggcccggtaccgggctggagccattggcaccgacgatgcactccacctgtttgacgaattgctccaggttgcctggccctcctcgatcgccgccatcaactgcctcctcattgtcgtcggccgtgattgccctgcgctcgccgtctccctcttcaaccacatcgcaagagccaaggtggcgccccacaatatcacctacggcattctagtcgactgctgcagccatgctggccgcttggaccttggcttcgctgccatgggccacatcgttaagacggtatttgcggcaggatccattgtctctttcagccacctgctcagggccgtctgtgcggagaagaagaccagctacggaatggacatcgtgctccgaattatgcctgagcttaactgcataccggatgtttactcctacagcatgcttttcaagggcctctgcaacgagaagagaagccaagaggctctcgagatgattcacgtgatggttgagcacggaggtagctgccaacctaatctggtctcatacaacgccgtaattgatggcttgttgaaagagggtgaggtgggcaaggcttacatcctattttgtgaaatggtacagagcgggattttggcaaatattgtgacctacaactcaattatctctggcatgtgcaaggttcatgcaatggacaaggctgagaaggttcttcaacagatgtttgatagagaaattctgccagatactgccacatatactagcctaatacatggatgttattcatcaggacaatgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgcattccagtattggcagaatggatgatgctatgccccaattcaatcaaatgatagccgaaggattagctcctgatatcatagttttcaacccccttattagtggtttttgtacttgtggcaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatatgctctcaattggctcgaaaccggat

SEQ ID NO: 2161 - DNA, 1779 bp, Triticum aestivum
atggtgagcatcggcgagcatgctcgtcctcctaactctgctttccttcttcctaatcccagttcatgcccaggttgcgtcggtgcggtggggggcgagcggcatcggcgtcctctgggtcctctgccattaccagattcttccagatccataggtggagctatgagccgccgcgccgtccccgctggcaggcgcatcttggagcagaacatcaaggcccggtaccgggctggagccattggcaccgacgatgcactccacctatttgacgaattgctccaggttgcctggccctcctcgatcgccgccatcaactgcctcctcattgtcgtcggccgtgattgccctgcgcttgccgtctccctcttcaaccacatcgcaagagccaaggtggcgccccacaatatcacctacggcattctagtcgactgctgcagccatgctggccgcttggaccttggcttcgctgccatgggccacatcgttaagacggtatttgcgacaggatccattgtctctttcagccacctgctcagggccgtctgtgcggagaagaagaccagctacggaatggacatcgtgctccgaattatgcctgagcttaactgcataccggatgtttactcctacagcatgcttttcaagggcctctgcaacgagaagagaagccaagaggctctcgagatgattcacgtgatggttgagcacggaggtagctgccaacctaatctggtctcatacaacgccataattgatggcttgttgaaagagggtgaggtgggcaaggcttacagcctattttgtgaaatggtacagagcgggattttggcaaatattgtgacctacaactcaatcatctctggcatgtgcaaggttcatgcaatggacaaggctgagaaggttcttcaacagatgtttgatagagaaattctgccagatactgccacatatactagcctaatacatggatgttattcatcaggacaatgcaaagaggtggaacgggttttcgagcacatgtctataaatggtgttcaaccaaatatgataacttacaatatacagatggattatctttgcaagagcggaagatgcacggaagctaggaagatctttgattctatggtcagtttgggccaaaaaccgtctgttactacctacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcggcaaggattgaaccctagtgttgcggactatggagcggtaataaacttgctttccagtattggcagaatggatgatgctatgccccaattcaatcaaatgatagccgaagtattagctcctgatatcatagttttcaacccccttattagtggtttttgtacttgtggcaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatatgctctcaattggctcgaaaccggat

SEQ ID NO: 2162 - DNA, 1779 bp, Triticum aestivum
atggtgagcatcggcgagcatgctcgtcctcctaactctactttccttcttcctaatcccagttcatgcccaggttgcgccggtgcggtggggggcgagcggcaccggcgtcctctgggtcctctgccattaccagattcttccagatccataggtggagctatgagccgccgcgccgtccccgctggcaggcgcatcttggagcagaacatcaaggcccggtaccgggctggagccattggcaccgacgatgcactccacctgtttgacgaattgctccaggttgcctggccctcctcgatcgccgccatcaactgcctcctcattgtcgtcggccgtgattgccctacgctcgccgtctccctcttcaaccacatcgcaagagccaaggtggcgccccacaatatcacctacggcattctagtcgactgctgcagccgtgctggccgcttggaccttggcttcgctgccatgggccacatcgttaagacgggatttgcggcaggatccgttgtctcttttagccacctgctcagggccgtctgtgcggagaagaagaccagctacggaatggacatcgtgctccgaattatgcctgagcttaactgcataccggatgtttactcctacagcattcttttcaagggcctctgcaacgagaagagaagccaagaggctctcgagctgattcacgtgatggttgagcacggaggtagctgccaacctaatctggtctcatacaacaccgtaattgatggcttgttgaaagagggtgaggtgggcaaggcttacagcctattttgtgaaatggtacagagcgggattttggcaaatattgtgacctacaactcaatcatctctggcatgtgcaaggttcatgcaatggacaaggctgagaaggttcttcaacagatgtttgatagagaaattctgccagatactgccacatatactagcctaatacatggatattattcatcaggacaatgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtttgttactacatacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggcaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatatgctctcaattggctcgaaaccggat

SEQ ID NO: 2163 - DNA, 1779 bp, Triticum aestivum
  misc_feature (1269)..(1269): n is a, c, g, or t
atggtgagcatcggtgagcatgctcgtcctcctaactctgctttccttcttcctaatcccagttcatgcccaggttgcgccggtgcggtggggggcgagcggcgccggcgtcctctgggtcctttgccattaccagattcttccagatccataggtggagctatgagccgccgcgccgtccccgctggcaggcgcatcttggagcagaacatcaaggcccggtaccgggctggagccattggcaccgacgatgcactccacctgtttgacgaattgctccaggttgcctggccctcctcgatcgccgccatcaactgcctcctcattggcgtcggccgtgattgccctgcgctcgccgtctccctcttcaaccacatcgcaagagccaaggtggcgccccacaatatcacctacggcattctagtcgactgctgcagccgtgctggccgcttggaccttggcttcgctgccatgggccacatcgttaagacgggatttgcggcaggatccgttgtctctttcagccacctgctcagggccgtctgtgcgaagaagaagaccagctacggaatggacatcgtgctccgaattatgcctgagcttaactgcataccggatgtttactcctacggcattcttttcaagggcctctgcaacgagaagagaagccaagaggctctcgagctgattcacgtgatggttgagcacggaggtagctgccaacctaatctggtctcatacaacaccgtaattgatggcttgttgaaagagggtgaggtgggcaaggcttacatcctattttgtgaaatggtacagagcgggattttggcaaatcttgtgacctacaactcaatcatctctggcatgtgcaaggttcatgcaatggacaaggctgagaaggttcttcaacagatgtttgatagagaaattctgccagatactgccacatatactagcctaatacatggatattattcatcaggacaatgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgatttgatggtagaaaatggtatctcaccagatcatcatgtctacaanatactcatatctgcatatgctaaagaggaaatggcaagtgaggtaatgcatatatttacaaaaatgcggcagcaaggattgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggcaaatgggagaaggttcatgaactattttctgaaatgttgaatcgcggcacctatcctgataccgtgttcttcaccacaattatggaccgcctttgcaaaaatggaagggttatggaagcccaagataagtttgacctgatggtacacatgggtgttaagcctaatgttcatacttatgccacattgatgcatcggtactttttcgttatgaagatggatgaagtgaggaagttacttggcaatatgctctcaattggctcgaaaccggat

SEQ ID NO: 2164 - DNA, 1779 bp, Triticum aestivum
atggtgagcatcggcgagcatgctcgtcctcctaactctgctttccttcttcctaatcccagttcatgcccaggttgcgtcggtgcggtggggggcgagcggcaccggcgtcctctaggtcctctgccattaccagattcttccagatccataggtggagctatgagccgccgcgccgtccccgctggcaggcgcatcttggagcagaacatcaaggcccggtaccgggctggagccattggcaccgacgatgcactccacctgtttgacgaattgctccaggttgcctggccctcctcgatcgccaccatcaactgcctcctcattgtcgtcggccgtgattgccctgcgctcgccgtctccctcttcaaccacatcgcaagagccaatgtggcgccccacaatatcacctacggcattctagtcgactgctgcagccgtgctggccgcttggaccttggcttcgctgccatgggccacatcgttaagacgggatttgcggcaggatccgttatctctttcagccacctgctcagggccgtctgtgcggagaagaagaccagctacggaatggacatcgtgctccgaattatgcctgagcttaactgcataccggatgtttactcctacagcattcttttcaagggcctctgcaacgagaagagaagccaagaggctctcgagctgattcacgtgatggttgagcacggaggtagctgccaacctaatctggtctcatacaacaccgtaattgatggcttgttgaaagagggtgaggtgggcaaggcttacagcctattttgtgaaatggtacagagcgggattttggcaaatattgtgacctacaactcaatcatctctggcatgtgcaaggttcatgcaatggacaaggctgagaaggttcttcaacagatgtttgatagagaaattctaccagatactgccacatatactagcctaatacatggatattattcatcaggacaatgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgattttatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggcaaatgggagaaggttcatgaactattttctgaaatgttgaatcgcggcacctatcatgataccgtgttcttcaccacaattatggaccgcctttgcaaaaatggaagggttatggaatcccaagatatgtttgacctgatggtacacgtgggtgttaagcctaatgttcatacttatgccacattgatgcatgggtactttttcgttaggaagatggatgaagtgaggaagttagttggcaatatgctctcaattggctcgaaaccggat

SEQ ID NO: 2165 - DNA, 1779 bp, Triticum aestivum
atggtgagcatcggcgagcatgctcgtcctcctaactctgctttccttcttcctaatcccagttcatgcccaggttgcgccggtgcggtggggggcgagcggcgccggcgtcctctgggtcctctgccattaccagattcttccagatccataggtggagctatgagccgccgcgctgtccccgctggcaggtgcatcttggagcagaacatcaaggcccggtaccgggctggagccattggcaccgacgatgcactccacctgtttgacgaactgctccaggttgcctggccctcctcgatcgccgccatcaactgccccctcattgtcgtcggccgtgattgccctgcgctcgccgtctccctcttcaaccacatcgcaagagccaaggtggcgccccacaatatcacctacggcattctagtcgactgctgcagccgtgctggccgcttggaccttggcttcgctgccatgggccacatcgttaagacgggatttgcggcaggatccgttgtctctttcagccacctgctcagggccgtctgtgcgaagaagaagaccagctacggaatggacatcgtgctccgaattatgcctgagcttaactgcataccggatgtttactcctacggcattcttttcaagggcctctgcaacgagaagagaagccaagaggctctcgagctgattcacgtgatggttgagcacggaggtagctgccaacctaatctggtctcatacaacaccataattgatggcttgttgaaagagggtgaggtgggcaaggcttacatcctattttgtgaaatggtacagagcgggattttggcaaatattgtgacctacaactcaatcatctctggcatgtgcaaggttcatgcaatggacaaggctgagaaggttcttcaacagatgtttgatagagaaattctgccagatactgccacatatactagcctaatacatggatattattcatcaggacaatgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgatttgatggtagaaaatggtatctcaccagatcatcatgtctacaagatactcatatctgcatatgctaaagaggaaatggcaagtgaggtaatgcatatatttacaaaaatgcggcagcaaggattgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggcaaatggcagaaggttcatgaactattttctgaaatgttgaatcgcggcacctatcctgataccgtgttcttcaccacaattatggactgcatttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatatgctctcaattggctcgaaaccggat

SEQ ID NO: 2166 - DNA, 1779 bp, Triticum aestivum
atggtgagcatcggcgagcatgctcgtcctcctaactctgctttccttcttcctaatcccagttcatgcccaggttgcgccggtgcggtggggggcgagcggcgccggcgtcctctgggtcctctgccactaccagattcttccagatccataggtggagctatgagccgccgcgccgtccccgctggcaggcgcatcttggagcagaacatcaaggcccggtaccgggctggagccattggcaccgacgatgcactccacctgtttgacgaattgctccaggttgcctggccctcctcgatcgccgccatcaactgcctcctcattgtcgtcggccgtgattgccctgcgctcgccgtctccctcttcaaccacatcgcaagagccaaggtggcgccccacaatatcacctacggcattctagtcgactgctgcagccgtgctggccgcttggaccttggcttcgctgccatgggccacatcgttaagacgggatttgcggcaggatccgttgtctcttttagccacctgctcagggccgtctgtgcggagaagaagaccagctacggaatggacatcgtgctccgaattatgcctgagcttaactgcataccggatgtttactcctacagcattcttttcaagggcctctgcaacgagaagagaagccaagaggctctcgagctgattcacgtgatggttgagcacggaggtagctgccaacctaatctggtctcatacaacaccgtaattgatggcttgttgaaagaaggtgaggtgggcaaggcttacagcctattttgtgaaatggtacagagcgggattttggcaaatattgtgacctacaactcaatcatctctggcatgtgcaaggttcatgcaatggacaaggctgagaaggttcttcaacagatgtttgatagagaaattctgccagatactgccacatatactagcctaatacatggatattattcatcaggacaatgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtttgttactacatacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggcaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatatgctctcgattggctcgaaaccggat

SEQ ID NO: 2167 - DNA, 1779 bp, Triticum aestivum
atggtgagcatcggcgagcatgctcgtcctcctaactctgctttccttcttcctaatcccagttcatgcccaggttgcgtcggtgcggtggggggcgagcggcaccggcgtcctctgggtcctctgccattaccagattcttccagatccataggtggagctatgagccgccgcgccgtccccgctggcaggcgcatcttggagcagaacatcaaggcccggtaccgggctggagccattggcaccgacgatgcactccacctgtttgacgaattgctccaggttgcctggccctcctcgatcgccgccatcaactgcctcctcattgtcgtcggccgtgattgccctgcgctcgccgtctccctcttcaaccacatcgcaagagccaaggtggcgccccacaatatcacctacggcattctagtcgactgctgcagccgtgctggccgcttggaccttggcttcgctgccatgggccacatcgttaagacgggatttgcggcaggatccgttgtctctttcagccacctgctcagggccgtctgtgcggagaagaagaccagctacggaatggacatcgtgctccgaattatgcctgagcttaactgcataccggatgtttactcctacagcattcttttcaagggcctctgcaacgagaagagaagccaagaggttctcgagctgattcacgtgatggttgagcacggaggtagctgccaacctaatctggtctcatacaacaccgtaattgatggcttgttgaaagagggtgaggtgggcaaggcttacagcctattttgtgaaatggtacagagcgggattttggcaaatattgtgacctacaactcaatcatctctggcatgtgcaaggttcatgcaatggacaaggctgagaaggttcttcaacagatgtttgatagagaaattctgccagatactgccacatatactagcctaatacatggatgttattcatcaggacaatgcaaagaggtggaacgggttttcgagcacatgtctataaatggtgttcaaccaaatatgataacttacaatgtacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggcaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatatgctctcaattggctcgaaaccggat

SEQ ID NO: 2168 - DNA, 1779 bp, Triticum aestivum
atggtgagcatcggcgagcatgctcgtcctcctaactctgctttccttcttcctaatcccagttcatgcccaggttgcgtcggtgcggtggggggcgagcggcatcggcgtcctctgggtcctctgccattaccagattcttccagatccataggtggagctatgagccgccgcgccgtccccgctggcaggcgcatcttggagcagaacatcaaggcccggtaccgggctggagccattggcaccgacgatgcactccacctatttgacgaattgctccaggttgcctggccctcctcgatcgccgccatcaactgcctcctcattgtcgtcggccgtgattgccctgcgctcgccgtctccctcttcaaccacatcgcaagagccaaggtggcgccccacaatatcacctacggcattctagtcgactgctgcagccatgctggccgcttggaccttggcttcgctgccatgggccacatcgttaagacggtatttgcgacaggatccattgtctctttcagccacctgctcagggccgtctgtgcggagaagaagaccagctacggaatggacatcgtgctccgaattatgcctgagcttaactgcataccggatgtttactcctacagcatgcttttcaagggcctctgcaacgagaagagaagccaagaggctctcgagatgattcacgtgatggttgagcacggaggtagctgccaacctaatctggtctcatacaacgccataattgatggcttgttgaaagagggtgaggtgggcaaggcttacagcctattttgtgaaatggtacagagcgggattttggcaaatattgtgacctacaactcaatcatctctggcatgtgcaaggttcatgcaatggacaaggctgagaaggttcttcaacagatgtttgatagagaaattctgccagatactgccacatatactagcctaatacatggatgttattcatcaggacaatgcaaagaggtggaacgggttttcgagcacatgtctataaatggtgttaaaccaaatatgataacttacaatatacagatggattatctttgcaagagcggaagatgcacggaagctaggaagatctttgattctatggtcagtttgggccaaaaaccgtctgttactacctacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcggcaaggattgaaccctagtgttgcggactatggagcggtaataaacttgctttccagtattggcagaatggatgatgctatgccccaattcaatcaaatgatagccgaagtattagctcctgatatcatagttttcaacccccttattagtggtttttgtacttgtggcaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatatgctctcaattggctcgaaaccggat

SEQ ID NO: 2169 - DNA, 1779 bp, Triticum aestivum
atggtgagcatcggtgagcatgctcgtcctcctaactctgctttccttcttcctaatcccagttcatgcccaggttgcgccggtgcggtggggggcgagcggcgccggcgtcctctgggtcctctgccattaccagattcttccagatccataggtggagctatgagccgccgcgccgtccccgctggcaggcgcatcttggagcagaacatcaaggcccggtaccgggctggagccattggcaccgacgatgcactccacctgtttgacgaattgctccaggttgcctggccctcctcgatcgccgccatcaactgcctcctcattgtcgtcggccgtgattgccctgcgctcgccgtctccctcttcaaccacatcgcaagagccaaggtggcgccccacaatatcacctacggcattctagtcgactgctgcagccgagctggccgcttggaccttggcttcgcggccatgggccacattgttaagacgggatttgcggtaggatccattgtctctttcagccacctgctcagggccgtctgtgcgaagaagaagaccagctacggaatggacatcgtgctccgaattatgcctgagcttaactgcataccggatgtttactcctacagcattcttttcaagggcctctgcaacgagaagagaagccaagaggctctcgagctgattcacgtgatggttgagcacggaggtagctgccaacctaatctggtctcatacaacaccgtaattgatggcttgttgaaagagggtgaggtgggcaaggcttacatcctattttgtgaaatggtacagagcgggattttggcaaatattgtgacctacaactcaatcatctctggcatgtgcaaggttcatgcaatggacaaggctgagaaggttcttcaacagatgtttgatagagaaattctgccagatactgccacatatactagcctaatacatggatattattcatcaggacaatgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgctttccagtattggcagaatggatgatgctatgtcccaattcaatcaaatgatagccgaaggattagctcctaatatcatagttttcaacccccttattagtggtttttgtacttgtggcaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacatgggtgttaagcctaatgttcatacttatgccacattgatgcatcggtactttttcgttaggaagatggatgaagtgaggaagttacttggcaatatgctctcaattggctcgaaaccggat

SEQ ID NO: 2170 - DNA, 1779 bp, Triticum aestivum
atggtgagcatcggtgagcatgctcgtcctcctaactctgctttccttcttcctaatcccagttcatgcccaggttgcgccggtgcggtggggggcgagcggcgccggcgtcctctgggtcctttgccattaccagattcttccagatccataggtggagctatgagccgccgcgccgtccccgctggcaggcgcatcttggagcagaacatcaaggcccggtaccgggctggagccattggcaccgacgatgcactccacctgtttgacgaattgctccaggttgcctggccctcctcgatcgccgccatcaactgcctcctcattggcgtcggccgtgattgccctgcgctcgccgtctccctcttcaaccacatcgcaagagccaaggtggcgccccacaatatcacctacggcattctagtcgactgctgcagccgtgctggccgcttggaccttggcttcgctgccatgggccacatcgttaagacgggatttgcggcaggatccgttgtctctttcagccacctgctcagggccgtctgtgcgaagaagaagaccagctacggaatggacatcgtgctccgaattatgcctgagcttaactgcataccggatgtttactcctacggcattcttttcaagggcctctgcaacgagaagagaagccaagaggctctcgagctgattcacgtgatggttgagcacggaggtagctgccaacctaatctggtctcatacaacaccgtaattgatggcttgttgaaagagggtgaggtgggcaaggcttacatcctattttgtgaaatggtacagagcgggattttggcaaatcttgtgacctacaactcaatcatctctggcatgtgcaaggttcatgcaatggacaaggctgagaaggttcttcaacagatgtttgatagagaaattctgccagatactgccacatatactagcctaatacatggatattattcatcaggacaatgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgatttgatggtagaaaatggtatctcaccagatcatcatgtctacaagatactcatatctgcatatgctaaagaggaaatggcaagtgaggtaatgcatatatttacaaaaatgcggcagcaaggattgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggcaaatgggagaaggttcatgaactattttctgaaatgttgaatcgcggcacctatcctgataccgtgttcttcaccacaattatggaccgcctttgcaaaaatggaagggttatggaagcccaagataagtttgacctgatggtacacatgggtgttaagcctaatgttcatacttatgccacattgatgcatcggtactttttcgttatgaagatggatgaagtgaggaagttacttggcaatatgctctcaattggctcgaaaccggat

SEQ ID NO: 2171 - DNA, 1779 bp, Triticum aestivum
atggtgagcatcggcgagcatgctcgtcctcctaactctgctttccttcttcctaatcccagttcatgcccaggttgcgccggtgcggtggggggcgagcggcgccggcgtcctctgggtcctctgccactaccagattcttccagatccataggtggagctatgagccgccgcgccgtccccgctggcaggcgcatcttggagcagaacatcaaggcccggtaccgggctggagccattggcaccgacgatgcactccacctgtttgacgaattgctccaggttgcctggccctcctcgatcgccgccatcaactgcctcctcattgtcgtcggccgtgattgccctgcgctcgccgtctccctcttcaaccacatcgcaagagccaaggtggcgccccacaatatcacctacggcattctagtcgactgctgcagccgtgctggccgcttggaccttggcttcgctgccatgggccacatcgttaagacgggatttgcggcaggatccgttgtctctttcagccacctgctcagggccgtctgtgcggagaagaagaccagctacggaatggacatcgtgctccgaattatgcctgagcttaactgcataccggatgtttactcctacagcattcttttcaagggcctctgcaacgagaagagaagccaagaggttctcgagctgattcacgtgatggttgagcacggaggtagctgccaacctaatctggtctcatacaacaccgtaattgatggcttgttgaaagagggtgaggtgggcaaggcttacagcctattttgtgaaatggtacagagcgggattttggcaaatattgtgacctacaactcaatcatctctggcatgtgcaaggttcatgcaatggacaaggctgagaaggttcttcaacagatgtttgatagagaaattctgccagatactgccacatatactagcctaatacatggatgttattcatcaggacaatgcaaagaggtggaacgggttttcgagcacatgtctataaatggtgttcaaccaaatatgataacttacaatgtacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggcaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatatgctctcaattggctcgaaaccggat

SEQ ID NO: 2172 - DNA, 1779 bp, Triticum aestivum; identical to SEQ ID NO: 2165

SEQ ID NO: 2173 - DNA, 573 bp, Triticum aestivum
atgcattgtctccttgatttgatggtagaaaatggtatctccccagatcatcatgtctacaacatactcatatctgcatatgctaaagaggaaatggcaagtgaggtaatgcatatatttacaaaaatacggcagcaaggattgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggcaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatatgctctcaattggctcgaaaccggat

SEQ ID NO: 2174 - DNA, 735 bp, Triticum aestivum
atgataacttacaatatacagatggattatctttgcaagagcggaagatgcgcggaagctaggaagatctttgattctatggtcagtttgggccaaaaaccgtytgttactacctacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgcattccagtattggcagaatggatgatgctatgccccaattcaatcaaatgatagccgaaggattagctcctgatatcatagttttcaacccccttattagtggtttttgtacttgtggcaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatatgctctcaattggctcgaaaccggat

SEQ ID NO: 2175 - DNA, 1779 bp, Triticum aestivum
atggtgagcatcggtgagcatgctcgtcctcctaactctgctttccttcttcctaatcccagttcatgcccaggttgcgccggtgcggtggggggcgagcggcgccggcgtcctctgggtcctctgccattaccagattcttccagatccataggtggagctatgagccgccgcgccgtccccgctggcaggcgcatcttggagcagaacatcaaggcccggtaccgggctggagccattggcaccgacgatgcactccacctgtttgacgaattgctccaggttgcctggccctcctcgatcgccgccatcaactgcctcctcattgtcgtcggccgtgattgccctgcgctcgccgtctccctcttcaaccacatcgcaagagccaaggtggcgccccacaatatcacctacggcattctagtcgactgctgcagccgagctggccgcttggaccttggcttcgcggccatgggccacattgttaagacgggatttgcggtaggatccattgtctctttcagccacctgctcagggccgtctgtgcgaagaagaagaccagctacggaatggacatcgtgctccgaattatgcctgagcttaactgcataccggatgtttactcctacagcattcttttcaagggcctctgcaacgagaagagaagccaagaggctctcgagctgattcacgtgatggttgagcacggaggtagctgccaacctaatctggtctcatacaacaccgtaattgatggcttgttgaaagagggtgaggtgggcaaggcttacatcctattttgtgaaatggtacagagcgggattttggcaaatattgtgacctacaactcaatcatctctggcatgtgcaaggttcatgcaatggacaaggctgagaaggttcttcaacagatgtttgatagagaaattctgccagatactgccacatatactagcctaatacatggatattattcatcaggacaatgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggcaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatatgctctcaattggctcgaaaccggat

SEQ ID NO: 2176 - DNA, 1344 bp, Triticum aestivum
  misc_feature (1306)..(1306): n is a, c, g, or t
atgggccacatcgttaagacgggatttgcggcaggatccgttgtctctttcagccacctgctcagggccgtctgtgcggagaagaagaccagctacggaatggacatcgtgctccgaattatgcctgagcttaactgcataccggatgtttactcctacagcattcttttcaagggcctctgcaacgagaagagaagccaagaggttctcgagctgattcacgtgatggttgagcacggaggtagctgccaacctaatctggtctcatacaacaccgtaattgatggcttgttgaaagagggtgaggtgggcaaggcttacagcctattttgtgaaatggtacagagcgggattttggcaaatattgtgacctacaactcaatcatctctggcatgtgcaaggttcatgcaatggacaaggctgagaaggttcttcaacagatgtttgatagagaaattctgccagatactgccacatatactagcctaatacatggatgttattcatcaggacaatgcaaagaggtggaacgggttttcgagcacatgtctataaatggtgttcaaccaaatatgataacttacaatgtacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggcaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatrtgctctcaattggctcgaaaccgngattaggagtgctctgcttcaaggttagtgccaggcca

SEQ ID NO: 2177 - DNA, 1779 bp, Triticum aestivum
atggtgagcatcggcgagcatgctcgtcctcctaactctgctttccttcttcctaatcccagttcatgcccaggttgcgccggtgcggtggggggcgagcggcgccggcgtcctctgggtcctctgccactaccagattcttccagatccataggtggagctatgagccgccgcgccgtccccgctggcaggcgcatcttggagcagaacatcaaggcccggtaccgggctggagccattggcaccgacgatgcactccacctgtttgacgaattgctccaggttgcctggccctcctcgatcgccgccatcaactgcctcctcattgtcgtcggccgtgattgccctgcgctcgccgtctccctcttcaaccacatcgcaagagccaaggtggcgccccacaatatcacctacggcattctagtcgactgctgcagccgtgctggccgcttggaccttggcttcgctgccatgggccacatcgttaagacgggatttgcggcaggatccgttgtctctttcagccacctgctcagggccgtctgtgcggagaagaagaccagctacggaatggacatcgtgctccgaattatgcctgagcttaactgcataccggatgtttactcctacagcattcttttcaagggcctctgcaacgagaagagaagccaagaggttctcgagctgattcacgtgatggttgagcacggaggtagctgccaacctaatctggtctcatacaacaccgtaattgatggcttgttgaaagagggtgaggtgggcaaggcttacagcctattttgtgaaatggtacagagcgggattttggcaaatattgtgacctacaactcaatcatctctggcatgtgcaaggttcatgcaatggacaaggctgagaaggttcttcaacagatgtttgatagagaaattctgccagatactgccacatatactagcctaatacatggatgttattcatcaggacaatgcaaagaggtggaacgggttttcgagcacatgtctataaatggtgttcaaccaaatatgataacttacaatgtacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgatttccagtattggcagaatggatgatgctatgtcccaattcaatcaaatgatagccgaaggattagctcctgatatcatagttttcaacccccttattagtggtttttgtacttgtggcaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatatgctctcaattggctcgaaaccggat

SEQ ID NO: 2178 - DNA, 762 bp, Triticum aestivum
atgtctataaatggtgttcaaccaaatatgataacttacaatatacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgtggcagcaaggattgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggcaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatatgctctcaattggctcgaaaccggat

SEQ ID NO: 2179 - DNA, 1779 bp, Triticum aestivum
atggtgagcatcggcgagcatgctcgtcctcctaactctgctttccttcttcctaatcccagttcatgcccaggttgcgccagtgcggtggggggcgagcggcgccggcgtcctctgggtcctctgccattaccagattcttccagatccataggtggatctatgagccgccgcgccgtccccgctggcaggcgcatcttggagcagaacatcaaggcccggtaccgggctggagccattggcaccgacgatgcacaccacctgtttgacgaattgctccaggttgcctggccctcctcaatcgccaccatcaactgcctcctcattgtcgtcggccgtgattgccctgcgctcgccatctccctcttcaaccacatcgcaagagccaaggtggcgccccacaatatcacctatggcattctagtcgactgctgcagccgtgctggccgcttggaccttggcttcactgccatgggccacattgttaagacgggatttgcggcaggatccgttgtctctttcagccacctgctcagggccgtctgtgcggagaagaagaccagctacggaatggacatcgtgctccgaattatgcctgagcttaactgcataccggatgtttactcctacagcactcttttcaagggcctctgcaacgagaagagaagccaagaggctctcgagctgattcacgtgatggttgagcacggaggtagctgccaacctaatctggtctcatacaacaccgtaattgatggcttgttgaaagagggtgaggtgggcaaggcttacagcctattttgtgaaatggtacagagcgggattttggcaaatattgtgacctacaactcaatcatctttgacatgtgcaaggttcatgcaatggacaaggctgagaaggttcttcaacagatgtttgatagagaaattctgccagatactgccacatatactagcctaatacatggatattattcatcaggacaatgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggcaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatatgctctcaattggctcgaaaccggat

SEQ ID NO: 2180 - DNA, 1779 bp, Triticum aestivum
atggtgagcatcggcgagcatgctcgtcctcctaactctgctttccttctacctaatcccagttcatgcccaggttgcgccggtgcggtggggggcgagcggcgccggcgtcctctgggtcctctgccattaccagattcttccagatccataggtggagctatgagccgccgcgccgtccccgctggcaggcgcatcttggagcagaacatcaaggcccggtaccgggctggagccattggcaccgacgatgcactccacctgtttgacgaattgctccaggttgcctggccctcctcaatcgccgccatcaactgcctcctcattgtcgtcggccgtgattgccctgcgctcgtcgtctccctcttcaaccacatcgcaagagccaaggtggcgccccacaatatcacctacgtcattctagtcgactgctgcagccgtgctggccgcttggaccttggcttcgctgccatgggccacattgttaagacgggatttgcggcaggatctgttgtctctttcagccacctgctcagggccgtctgtgcggagaagaagaccagctacggaatggacatcgtgctccgaattatgcctgagcttaactgcataccggatgtttactcctacagcattcttttcaagggcctctgcaacgagaagagaagccaagaggctctcgagctgattcacgtgatggttgagcacggaggtagctgccaacctaatctggtctcatataacaccgtaattgatggcttgttgaaagagggtgaggtgggcaaggcttacagcctattttgtgaaatggtacagagcgggattttggcaaatattgtgacctacaactcaatcatctttggcatgtgcaaggttcatgcaatggacaaggctgagaaggttcttcaacagatgtttgatagagaaattctgccagatactgccacatatactagcctaatacatggatattattcatcaggacaatgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgtggcagcaaggattgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggcaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatatgctctcaattggctcgaaaccggat

SEQ ID NO: 2181 - DNA, 1779 bp, Triticum aestivum; identical to SEQ ID NO: 2168

SEQ ID NO: 2182 - DNA, 1779 bp, Triticum aestivum
atggtgagcatcggcgagcatgctcgtcctcctaactctgctttccttcttcctaatcccagttcatgcccaggttgcgtcggtgcggtggggggcgagcggcatcggcgtcctctgggtcctctgccattaccagattcttccagatccataggtggagctatgagccgccgcgccgtccccgctggcaggcgcatcttggagcagaacatcaaggcccggtaccgggctggagccattggcaccgacgatgcactccacctatttgacgaattgctccaggttgcctggccctcctcgatcgccgccatcaactgcctcctcattgtcgtcggccgtgattgccctgcgctcgccgtctccctcttcaaccacatcgcaagagccaaggtggcgccccacaatatcacctacggcattctagtcgactgctgcagccatgctggccgcttggaccttggcttcgctgccatgggccacatcgttaagacggtatttgcgacaggatccattgtctctttcagccacctgctcagggccgtctgtgcggagaagaagaccagctacggaatggacatcgtgctccgaattatgcctgagcttaactgcataccggatgtttactcctacagcatgcttttcaagggcctctgcaacgagaagagaagccaagaggctctcgagctgattcacgtgatggttgagcacggaggtagctgccaacctaatctggtctcatacaacgccataattgatggcttgttgaaagagggtgaggtgggcaaggcttacagcctattttgtgaaatggtacagagcgggattttggcaaatattgtgacctacaactcaatcatctctggcatgtgcaaggttcatgcaatggacaaggctgagaaggttcttcaacagatgtttgatagagaaattctgccagatactgccacatatactagcctaatacatggatgttattcatcaggacaatgcaaagaggtggaacgggttttcgagcacatgtctataaatggtgttcaaccaaatatgataacttacaatatacagatggattatctttgcaagagcggaagatgcacggaagctaggaagatctttgattctatggtcagtttgggccaaaaaccgtctgttactacctacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcggcaaggattgaaccctagtgttgcggactatggagcggtaataaacttgctttccagtattggcagaatggatgatgctatgccccaattcaatcaaatgatagccgaagtattagctcctgatatcatagttttcaacccccttattagtggtttttgtacttgtggcaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatatgctctcaattggctcgaaaccggat

SEQ ID NO: 2183 - DNA, 1779 bp, Triticum aestivum; identical to SEQ ID NO: 2160

SEQ ID NO: 2184 - DNA, 1779 bp, Triticum aestivum
atggtgagcatcggcgagcatgctcgtcctcctaactctgctttccttcttcctaatcccagttcatgcccaggttgcgtcggtgcggtggggggcgagcggcaccggcgtcctctaggtcctctgccattaccagattcttccagatccataggtggagctatgagccgccgcgccgtccccgctggcaggcgcatcttggagcagaacatcaaggcccggtaccgggctggagccattggcaccgacgatgcactccacctgtttgacgaattgctccaggttgcctggccctcctcgatcgccaccatcaactgcctcctcattgtcgtcggccgtgattgccctgcgctcgccgtctccctcttcaaccacatcgcaagagccaaggtggcgccccacaatatcacctacggcattctagtcgactgctgcagccgtgctggccgcttggaccttggcttcgctgccatgggccacatcgttaagacgggatttgcggcaggatccgttatctctttcagccacctgctcagggccgtctgtgcggagaagaagaccagctacggaatggacatcgtgctccgaattatgcctgagcttaactgcataccggatgtttactcctacagcattcttttcaagggcctctgcaacgagaagagaagccaagaggctctcgagctgattcacgtgatggttgagcacggaggtagctgccaacctaatctggtctcatacaacaccgtaattgatggcttgttgaaagagggtgaggtgggcaaggcttacagcctattttgtgaaatggtacagagcgggattttggcaaatattgtgacctacaactcaatcatctctggcatgtgcaaggttcatgcaatggacaaggctgagaaggttcttcaacagatgtttgatagagaaattctaccagatactgccacatatactagcctaatacatggatattattcatcaggacaatgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgattttatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggcaaatgggagaaggttcatgaactattttctgaaatgttgaatcgcggcacctatcatgataccgtgttcttcaccacaattatggaccgcctttgcaaaaatggaagggttatggaatcccaagatatgtttgacctgatggtacacgtgggtgttaagcctaatgttcatacttatgccacattgatgcatgggtactttttcgttaggaagatggatgaagtgaggaagttagttggcaatatgctctcaattggctcgaaaccggat

SEQ ID NO: 2185 - DNA, 1779 bp, Triticum aestivum; identical to SEQ ID NO: 2160

SEQ ID NO: 2186 - DNA, 1779 bp, Triticum aestivum
atggtgagcatcggcgagcatgctcgtcctcctaactctgctttccttcttcctaatcccagttcatgcccaggttgcgtcggtgcggtggggggcgagcggcaccggcgtcctctaggtcctctgccattaccagattcttccagatccataggtggagctatgagccgccgcgccgtccccgctggcaggcgcatcttggagcagaacatcaaggcccggtaccgggctagagccattggcaccgacgatgcactccacctgtttgacgaattgctccaggttgcctggccctcctcgatcgccgccatcaactgcctcctcattgtcgtcggccgtgattgccctgcgctcgccgtctccctcttcaaccacatcgcaagagccaaggtggcgccccacaatatcacctacggcattctagtcgactgctgcagccgtgctggccgcttggaccttggcttcgctgccatgggccacatcgttaagacgggatttgcggcaggatccgttatctctttcagccacctgctcagggccgtctgtgcggagaagaagaccagctacggaatggacatcgtgctccgaattatgcctgagcttaactgcataccggatgtttactcctacagcattcttttcaagggcctctgcaacgagaagagaagccaagaggctctcgagctgattcacgtgatggttgagcacggaggtagctgccaacctaatctggtctcatacaacaccgtaattgatggcttgttgaaagagggtgaggtgggcaaggcttacagcctattttgtgaaatggtacagagcgggattttggcaaatattgtgacctacaactcaatcatctctggcatgtgcaaggttcatgcaatggacaaggctgagaaggttcttcaacagatgtttgatagagaaattctaccagatactgccacatatactagcctaatacatggatattattcatcaggacaatgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgattttatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggcaaatgggagaaggttcatgaactattttctgaaatgttgaatcgcggcacctatcmtgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatatgctctcaattggctcgaaaccggat

SEQ ID NO: 2187 - DNA, 1551 bp, Triticum aestivum
atgcgcccatgccggacgcctctcctcgactccacctcgccgctgtccgtgctcctcctcgaccacctccaccgcaatcgcccctcccctcccccctcagcctcgccgccgtcagccttctggtctcccatcgccgcattcgccgctgccacaaagcgcgcccgagccgggacgctcagccctgaggacgcacaccacctgttcgacgaattgctacgccagtccaacccggtccccaatcgcttcctgaacagcttccttgccgccctcgcccgtgctccaccctccgacgcctgcggagatggccccgccctcaccgtcgccctcttcaaccgcctgtgccgagaagaggccggcccttgtgtagcgccgcccactatctatacctacagcattctaatggacagctgctgccgcgtgggtcgcccggaccttgggcttgctgtcttcggccgcctactcaagtcgggcttcaaggcagaccagagcactgccagcagcctcctcatgtgcctctgcgatgtaggacggacaaacgaggctgtggacgtgctgcttcataggatctccgagctcggctgtgagcctaatgtcatcccatacaacatagttcttaagagcttatgtgacagtagaaggagccagcaagctcttgacctgctccagatgatggcacaaagaggttgctgctcccctaatgtggtgtcatataacaccgtcattcatggcttatttaaggaaggtgaagtaagcatggcgtgctcattattctatgaaatgatgcggcaaagggttatgcctaatgtggtgacatatagatcgatgattggtgcgttgtgcaaggtcggggcaacggacaaggcaaagctggtccttggtcatatggttggtaatggttttcgaccagataagtatatttggaactcattcatggcatctctttgcaagcagggaagaagcaaggaagctgcacaactttttgattacatggtcgccaagggccacaaacctgatgttgtcacgtactctactctgcttcatgggtatgctactgaaggatgcttcactgatatgattaatctctttaattcaatggaaggcaacggtattgtagctaacagctgtgtttttaacatactaattgacgcatatgctaaacgtggaatgatgcatgaagctatgctcatatttactgaaatgcgggaacgaagagtgagtcctgatatattcacctatggaattataatagctgcactttgcagaatgggtaggctatctgatgctatggagaaaataaatgaaatggttgctacaggattacaaccggacaaggctgtttactattccctaattcagggtttttgtacacatgatgatttggtcaaagctaaggagttggtttctgagatgatgaccaaaggtattcctcgtcctaacattgtgttcttcaactcggtaatagccagtctgtgcaaagaaggaagggttaaggatgcacacggtatctttgacttggctctgaacattggtgagaggcccgatttaattcac

SEQ ID NO: 2188 - DNA, 1551 bp, Triticum aestivum; identical to SEQ ID NO: 2187

SEQ ID NO: 2189 - DNA, 1551 bp, Triticum aestivum; identical to SEQ ID NO: 2187

SEQ ID NO: 2190 - DNA, 1551 bp, Triticum aestivum; identical to SEQ ID NO: 2187

SEQ ID NO: 2191 - DNA, 1551 bp, Triticum aestivum; identical to SEQ ID NO: 2187

SEQ ID NO: 2192 - DNA, 1551 bp, Triticum aestivum; identical to SEQ ID NO: 2187

SEQ ID NO: 2193 - DNA, 1779 bp, Triticum aestivum
atggtgagcatcggcgagcatgctcgtcctcctaactctgctttccttcttcctaatcccagttcatgcccaggttgcgccagtgcggtggggggcgagcggcgccggcgtcctctgggtcctctgccattaccagattcttccagatccataggtggatctatgagccgccgcgccgtccccgctggcaggcgcatcttggagcagaacatcaaggcccggtaccgggctggagccattggcaccgacgatgcacaccacctgtttgacgaattgctccaggttgcctggccctcctcaatcgccaccatcaactgcctcctcattgtcgtcggccgtgattgccctgcgctcgccatctccctcttcaaccacatcgcaagagccaaggtggcgccccacaatatcacctatggcattctagtcgactgctgcagccgtgctggccgcttggaccttggcttcactgccatgggccacattgttaagacgggatttgcggcaggatccgttgtctctttcagccacctgctcagggccgtctgtgcggagaagaagaccagctacggaatggacatcgtgctccgaattatgcctgagcttaactgcataccggatgtttactcctacagcactcttttcaagggcctctgcaacgagaagagaagccaagaggctctcgagctgattcacgtgatggttgagcacggaggtagctgccaacctaatctggtctcatacaacaccgtaattgatggcttgttgaaagagggtgaggtgggcaaggcttacagcctattttgtgaaatggtacagagcgggattttggcaaatattgtgacctacaactcaatcatctttgacatgtgcaaggttcatgcaatggacaaggctgagaaggttcttcaacagatgtttgatagagaaattctgccagatactgccacatatactagcctaatacatggatattattcatcaggacaatgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgctttccagtattggcagaatggatgatgctatgtcccaattcaatcaaatgatagccgaaggattagctcctaatatcatagttttcaacccccttattagtggtttttgtacttgtggcaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacatgggtgttaagcctaatgttcatacttatgccacattgatgcatcggtactttttcgttaggaagatggatgaagtgaggaagttacttggcaatatgctctcaattggctcgaaaccggat

SEQ ID NO: 2194 - DNA, 1308 bp, Triticum aestivum
atgggccacatcgttaagacgggatttgcggcaggatccgttgtctctttcagccacctgctcagggccgtctgtgcggagaagaagaccagctacggaatggacatcgtgctccgaattatgcctgagcttaactgcataccggatgtttactcctacaacattcttttcaagggcctctgcaacgagaagagaagccaagaggctctcgagctgattcacgtgatggttgagcacggaggtagctgccaacctaatctggtctcatacaacaccgtaattgatggcttgttgaaagagggtgaggtgggcaaggcttacagcctattttgtgaaatggtacagagcgggattttggcaaatattgtgacctacaactcaatcatctctggcatgtgcaaggttcatgcaatggacaaggctgagaaggttcttcaacagatgtttgatagagaaattctgccagatactgccacatatactagcctaatacatggatattattcatcaggacaatgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtctgttactacatacagtattctgcttcatggttatgttatggaaaaatcatttcatgatatgcattgtctccttgatttgatggtagaaaatggtatctccccagatcatcatgtctacaacatactcatatctgcatatgctaaagaggaaatggcaagtgaggtaatgcatatatttacaaaaatacggcagcaaggattgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggcaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatatgctctcaattggctcgaaaccggat

SEQ ID NO: 2195 - DNA, 1770 bp, Triticum aestivum
atggtgagcatcggcgagcatgctcgtcctcctaactctactttccttcttcctaatcccagttcatgcccaggttgcgccggtgcggtggggggcgagcggcaccggcgtcctctgggtcctctgccattaccagattcttccagatccataggtggagctatgagccgccgcgccgtccccgctggcaggcgcatcttggagcagaacatcaaggcccggtaccgggctggagccattggcaccgacgatgcactccacctgtttgacgaattgctccaggttgcctggccctcctcgatcgccgccatcaactgcctcctcattgtcgtcggccgtgattgccctgcgctcgccgtctccctcttcaaccacatcgcaagagccaaggtggcgccccacaatatcacctacggcattctagtcgactgctgcagccgtgctggccgcttggaccttggcttcgctgccatgggccacatcgttaagacgggatttgcggcaggatccgttgtctcttttagccacctgctcagggccgtctgtgcggagaagaagaccagctacggaatggacatcgtgctccgaattatgcctgagcttaactgcataccggatgtttactcctacagcattcttttcaagggcctctgcaacgagaagagaagccaagaggctctcgagctgattcacgtgatggttgagcacggaggtagctgccaacctaatctggtctcatacaacaccgtaattgatggcttgttgaaagagggtgaggtgggcaaggcttacagcctattttgtgaaatggtacagagcgggattttggcaaatattgtgacctacaactcaatcatctctggcatgtgcaaggttcatgcaatggacaaggctgagaaggttcttcaacagatgtttgatagagaaattctgccagatactgccacatatactagcctaatacatggatattattcatcaggacaatgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtttgttactacatacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggcaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatawgtcaaagcaacgtttt

SEQ ID NO: 2196 - DNA, 1308 bp, Triticum aestivum
  misc_feature (1289)..(1289): n is a, c, g, or t
atgggccacatcgttaagacgggatttgcggcaggatccgttgtctctttcagccacctgctcagggccgtctgtgcggagaagaagaccagctacggaatggacatcgtgctccgaattatgcctgagcttaactgcataccggatgtttactcctacagcattcttttcaagggcctctgcaacgagaagagaagccaagaggctctcgagctgattcacgtgatggttgagcacggaggtagctgccaacctaatctggtctcatacaacaccgtaattgatggcttgttgaaagagggtgaggtgggcaaggcttacagcctattttgtgaaatggtacagagcgggattttggcaaatattgtgacctacaactcaatcatctctggcatgtgcaaggttcatgcaatggacaaggctgagaaggttcttcaacagatgtttgatagagaaattctgccagatactgccacatatactagcctaatacatggatattattcatcaggacaatgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtttgttactacatacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggcaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatatgctctnaattggctcgaaaccggat

SEQ ID NO: 2197 - DNA, 1308 bp, Triticum aestivum; identical to SEQ ID NO: 2194

SEQ ID NO: 2198 - DNA, 1308 bp, Triticum aestivum; identical to SEQ ID NO: 2194

SEQ ID NO: 2199 - DNA, 1701 bp, Triticum aestivum
atgagccgccgccttgtccccgtcgacagacgcatcttggagcagaacatcaaggctcggtaccacgccggagacattggcacccaggatgcactccacctgtttgacgaattgctccagtgtgctgggtcctcctcgatccgtgccatcaactatctcgttactactgtcggccgtgattgccctgcgctcggcgtctccctcttcaaccgcgtcgcaagtgccaatgtggcaccaaacagtatcacgtacaccatcctcgtcgactgctgctgccgtgctggccgcttggacctcggtttcgctgccatgggccacatcatcaagatgggatttgcagcagatgctatcgtcactttcagccacctactcaatgccatctgtgcggagaagaagaccagctatgcaatggacatcgtactccgaataatgcccatgtttaactgtgttccgaacattttctcctacagcattcttttcaagggtctctgcaacgagaagagaagccaagaggctctcgagctgattcaggtgatggttgagcatggaggtagctgccaacctaatgtggtgtcctatagcaccgtaattgatggcttgttgaaagagggtttggtgggcaaggcttacagtctattctgtgaaatgctacagaggggaatttcgccaaatgctgtgacctgtagttcaatcatctctggcatgtgcaaggctcaatcaatggacaagtctgaggaggttcttcaacagatgcttgatagacgaattctgccagatgttaccacatataatagtctgatacatggatattattcatcaggaaggtgcaaagaagttgatcggattttccaggaaatgtctagaaatggtgttcaaccaaatattgtaacttacaatatacagatggattatctttgcaagagcggaaggtgcgcagaagctaggaaaatatttgattctatgatcggtctgggccaaaaaccagatgttactacctacagtattctgcttcatgggtctgccatggaaaaatcttttcatgagatgcattgtctcattgatttgatggtgggaaatggtatctcaccagatcatcatgtctacaacatactcatgtctgcatatgctaaagaagaaacggttggtgaggtaatgcatatatttacaaaaatgcggcagcaaggactgaaccctaatgtagcaaactatggagcggcagtaaacttgctttccaagattggccgaatggatgatgctatgtcccaattcaatcaaatgataactgaagggttagctcctgatatcatagttttcaccccccttattagtggtttctgttcttgtggcaaatgggagaaggttgatgaactattttctgagatgttggatcgcggcatatgtcccaacacagtgttcttcaacacaattatggaccgcctttgcaaaaatgaaagggttatggaagcccaagatctcttcgacctgatggtacacatgggtgtgaagcctgatgtgtgtacttatagcacactgataggtggatacttgttcgttggtaagatggatgaagtgagcaagttacttgacaatatggtctcaattggcatggaaccagatgttatcacctataacatactgatgcacctcatatacctcatatatatccatcttgtctgttatgtcccatggacatatctcatt

SEQ ID NO: 2200 - DNA, 1701 bp, Triticum aestivum
atgagccgccgccttgtccccgtcgacagacgcatcttggagcagaacatcaaggctcggtaccacgccggagacattggcacccaggatgcactccacctgtttgacgaattgctccagtgtgctgggtcctcctcgatccgtgccatcaactatctcgttactactgtcggccgtgattgccctgcgctcggcgtctccctcttcaaccgcgtcgcaagtgccaatgtggcaccaaacagtatcacgtacaccatcctcgtcgactgctgctgccgtgctggccgcttggacctcggtttcgctgccatgggccacatcatcaagatgggatttgcagcagatgctatcgtcactttcagccacctactcaatgccatctgtgcggagaagaagaccagctatgcaatggacatcgtactccgaataatgcccatgtttaactgtgttccgaacattttctcctacagcattcttttcaagggtctctgcaacgagaagagaagccaagaggctctcgagctgattcaggtgatggttgagcatggaggtagctgccaacctaatgtggtgtcctatagcaccgtaattgatggcttgttgaaagagggtttggtgggcaaggcttacagtctattctgtgaaatgctacagaggggaatttcgccaaatgctgtgacctgtagttcaatcatctctggcatgtgcaaggctcaatcaatggacaagtctgaggaggttcttcaacagatgcttgatagacgaattctgccagatgttaccacatataatagtctgatacatggatattattcatcaggaaggtgcaaagaagttgatcggattttccaggaaatgtctagaaatggtgttcaaccaaatattgtaacttacaatatacagatggattatctttgcaagagcggaaggtgcgcagaagctaggaaaatatttgattctatgatcggtctgggccaaaaaccagatgttactacctacagtattctgcttcatgggtctgccatggaaaaatcttttcatgagatgcattgtctcattgatttgatggtgggaaatggtatctcaccagatcatcatgtctacaacatactcatatctgcatatgctaaagaagaaacggttggtgaggtaatgcatatatttacaaaaatgcggcagcaaggactgaaccctaatgtagcaaactatggagcggcagtaaacttgctttccaagattggccgaatggatgatgctatgtcccaattcaatcaaatgataactgaagggttagctcctgatatcatagttttcaccccccttattagtggtttctgttcttgtggcaaatgggagaaggttgatgaactattttctgagatgttggatcgcggcatatgtcccaacacagtgttcttcaacacaattatggaccgcctttgcaaaaatgaaagggttatggaagcccaagatctcttcgacctgatggtacacatgggtgtgaagcctgatgtgtgtacttatagcacactgataggtggatacttgttcgttggtaagatggatgaagtgagcaagttacttgacaatatggtctcaattggcatggaaccagatgttatcacctataacatactgatgcacctcatatacctcatatatatccatcttgtctgttatgtcccatggacatatctcatt

SEQ ID NO: 2201 - DNA, 1701 bp, Triticum aestivum; identical to SEQ ID NO: 2200

SEQ ID NO: 2202 - DNA, 1701 bp, Triticum aestivum; identical to SEQ ID NO: 2200

SEQ ID NO: 2203 - DNA, 1701 bp, Triticum aestivum; identical to SEQ ID NO: 2199

SEQ ID NO: 2204 - DNA, 1701 bp, Triticum aestivum; identical to SEQ ID NO: 2199

SEQ ID NO: 2205 - DNA, 1779 bp, Triticum aestivum
atgtcgggcctccgtctccgcccccgccgctcgtcatcttctacctttccgatgccccgctcccgcctccgtcactacgcctccgccatgccgatgtccagcctccgtcccctccaccgcagctcctcctccaccacgtcgcctgcacgcgcctggtccccccatgccgccttcgccgcggccacggagcgtgtccgcgccggggcgctcaggccggaagacgcacacaccctgttcgacgaattgcttcggcaggccacaccggtccccgagcgatccctcaacggcttccttgccgccctcgcccgtgcgcccgcctccggaaactgcatcagagatggccccgcccttgcagtggttctcttcaaccgtgtgtgcagagaggaagccggcccgcaggtggcggcgctcacaggctgcacctacagcatcctcatggactgctactgccgcgcccgtcgcccggacctagggcttgccttatttggccgcttcctcagggaaggcctgaagacacaccagatcgtcgccaacaccttcctcaagtgcctctgctatgcgaaattgacggatgaggcagtggacgtgctgcttcataggatgtccgagttcgggtgtgtgcctgatgccatctcatacaacactgtcctgaagagcttatgcgacaatggcatgagccagcgggggctcgaactgctccagatgattgcaaaagaagtaggtgtctgctctctcaatctggtggcatataacacggtcatctacggcttctttaaggaaggtgaaacaggcaaggcatgcaatctattccatgaaatgatgcagcaaggtgttgagcccgatgtggtgacttacaacttgatcattgatgctttgtgcaaggccagagcaatggacaaggcagaagtagtccttcagcagatgatcagtaaaggtgctcaacctgatacagtgacatataattgcatgatcaatggatatgccacatctgggcggttgaaaaaatctgctaaaatgttcagagaaatgaaaagccggggtcttatgccagatattgttacttgcaactccttcctgtcctccctttgcaagcatggaagaagcaaagaagctagagaaatatttgattccatgaccgccaagggccacaaaccggatatcgtctcataccgtattttgcttcatgggtatgccagtgaaggatgctttgctgatatgattgatctctttaattcaatgaaaagcaatggtattgcagctgactgccgtgttttcaccatattaattggtgcctatgctaaacacggaatgatggatgatgcaatgctcatatttacggaaatgcagcaacaaggtctgagtccaaatgtagtgacatattcaactgtcatatcagcactttctagaatgggtaggttggccaatgctatggagaaatttaatcagatgatttccatgggggttcaaccgaacaaagctgtttatcacaccctaattcagggctcttgtatgcatggtgatttgattaaagccaaggagctggtttctgaaatgatgaacaaaggtattcctcatcctagcattacgttcttcggttcaataataaacagtttatgcaaagatggaagggttatggatgcacatgatatctttgacttggttatagacataggtgagaggcctagtgccattacatttaattcactggttgacggatattgcttagttggcaagatggataaagcatttggaatgcttaatgccatggaatcactggta

SEQ ID NO: 2206 - DNA, 1779 bp, Triticum aestivum
atgtcgggcctccgtctccgcccccgccgctcgtcatcttctacctttccgatgccccgctcccgcctccgtcactacgcctccgccatgccgatgtccagcctccgtcccctccaccgcagctcctcctccaccacgtcgcctgcacgcgcctggtccccccatgccgccttcgccgcggccacggagcgtgtccgcgccggggcgctcaggccggaagacgcacacaccctgttcgacgaattgcttcggcaggccacaccggtccccgagcgatccctcaacggcttccttgccgccctcgcccgtgcgcccgcctccggaaactgcatcagagatggccccgcccttgcagtggttctcttcaaccgtgtgtgcagagaggaagccggcccgcaggtggcggcgctcacaggctgcacctacagcatcctcatggactgctactgccgcgcccgtcgcccggacctagggcttgccttatttggccgcttcctcagggaaggcctgaagacacaccagatcgtcgccaacaccttcctcaagtgcctctgctatgcgaaattgacggatgaggcagtggacgtgctgcttcataggatgtccgagttcgggtgtgtgcctgatgccatctcatacaacactgtcctgaagagcttatgcgacaatggcatgagccagcgggggctcgaactgctccagatgattgcaaaagaagtaggtgtctgctctctcaatctggtggcatataacacggtcatctacggcttctttaaggaaggtgaaacaggcaaggcatgcaatctattccatgaaatgatgcagcaaggtgttgagcccgatgtggtgacttacaacttgatcattgatgctttgtgcaaggccagagcaatggacaaggcagaagtagtccttcagcagatgatcagtaaaggtgctcaacctgatacagtgacatataattgcatgatcaatggatatgccacatctgggcggttgaaaaaatctgctaaaatgttcagagaaatgaaaagccggggtcttatgccagatattgttacttgcaactccttcctgtcctccctttgcaagcatggaagaagcaaagaagctagagaaatatttgattccatgaccgccaagggccacaaaccggatatcgtctcataccgtattttgcttcatgggtatgccagtgaaggatgctttgctgatatgattgatctctttaattcaatgaaaagcaatggtattgcagctgactgccgtgttttcaccatattaattggtgcctatgctaaacacggaatgatggatgatgcaatgctcatatttacggaaatgcagcaacaaggtctgagtccaaatgtagtgacatattcaactgtaatatcagcactttctagaatgggtaggttggccaatgctatggagaaatttaatcagatgatttccatgggggttcaaccgaacaaagctgtttatcacaccctaattcagggctcttgtatgcatggtgatttgattaaagccaaggagctggtttctgaaatgatgaacaaaggtattcctcatcctagcattacgttcttcggttcaataataaacagtttatgcaaagatggaagggttatggatgcacatgatatctttgacttggttatagacataggtgagaggcctagtgccattacatttaattcactggttgacggatattgcttagttggcaagatggataaagcatttggaatgcttaatgccatggaatcactggta

SEQ ID NO: 2207 - DNA, 1779 bp, Triticum aestivum
atgtcgggcctccgtctccgtccccgccgctcgtcatcttctacctttccgatgccccgctcccgcctccgtcactacgcctccgccatgccgatgtccagcctccgtcccctccaccgcagctcctcctccaccacgtcgcctgcatgcgcctggtccccccatgccgccttcgccgcggccacggagcgtgtccgcgccggggcgctcaggccggaagacgcacacaccctgttcgacgaattgcttcggcaggccacaccggtccccgagcgatccctcaacggcttccttgccgccctcgcccgtgcgcccgcctccggaaactgcatcagagatggccccgcccttgcagtggttctcttcaaccgtgtgtgcagagaggaagccggcccgcaggtggcggcgctcacaggctgcacctacagcatcctcatggactgctactgccgcgcccgtcgcccggacctagggcttgccttatttggccgcttcctcagggaaggcctgaagacacaccagatcgtcgccaacaccttcctcaagtgcctctgctatgcgaaattgacggatgaggcagtggacgtgctgcttcataggatgtccgagctcgggtgtgtgcctgatgccatctcatacaacactgtcctgaagagcttatgcgacaatggcatgagccagcgggggctcgaactgctccagatgattgcaaaagaagtaggtgtctgctctctcaatctggtggcatataacacggtcatctacggcttctttaaggaaggtgaaacaggcaaggcatgcaatctattccatgaaatgatgcagcaaggtgttgagcccgatgtggtgacttacaacttgatcattgatgctttgtgcaaggccagagcaatggacaaggcagaagtagtccttcagcagatgatcagtaaaggtgctcaacctcatacagtgacatataattgcatgatcaatggatatgccacatctgggcggttgaaaaagtctgctaaaatgttcagagaaatgaaaagccggggtcttatgccagatattgttacttgcaactccttcctgtcctccctttgcaagcatggaagaagcaaagaagctagagaaatatttgattccatgaccgccaagggccacaaaccggatatcgtctcataccgtattttgcttcatgggtatgccagtgaaggatgctttgctgatatgattgatctctttaattcaatgaaaagcaatggtattgcagctgactgccgtgttttcaccatattaattggtgcctatgctaaacacggaatgatggatgatgcaatgctcatatttacggaaatgcagcaacaaggtctgagtccaaatgtagtgacatattcaactgtaatatcagcactttctagaatgggtaggttggccaatgctatggagaaatttaatcagatgatttccatgggggttcaaccgaacaaagctgtttatcacaccctaattcagggctcttgtatgcatggtgatttgattaaagccaaggagctggtttctgaaatgatgaacaaaggtattcctcgtcctagcattacgttcttcggttcaataataaacagtttatgcaaagatggaagggttatggatgcacatgatatctttgacttggttatagacataggtgagaggcctagtgccattacatttaattcactggttgacggatattgcttagttggcaagatggataaagcatttggaatgcttaatgccatggaatcactggta

SEQ ID NO: 2208 - DNA, 1779 bp, Triticum aestivum; identical to SEQ ID NO: 2206

SEQ ID NO: 2209 - DNA, 1779 bp, Triticum aestivum
atgtcgggcctccgtctccgtccccgccgctcgtcatcttctacctttccgatgccccgctcccgcctccgtcactacgcctccgccatgccgatgtccagcctccgtcccctccaccgcagctcctcctccaccacgtcgcctgcatgcgcctggtccccccatgccgccttcgccgcggccacggagcgtgtccgcgccggggcgctcaggccggaagacgcacacaccctgttcgacgaattgcttcggcaggccacaccggtccccgagcgatccctcaacggcttccttgccgccctcgcccgtgcgcccgcctccggaaactgcatcagagatggccccgccctcgcagtggttctcttcaaccgtgtgtgcagagaggaagccggcccgcaggtggcggcgctcacaggctgcacctacagcatcctcatggactgctactgccgcgcccgtcgcccggacctagggcttgccttatttggccgcttcctcagggaaggcctgaagacacaccagatcgtcgccaacaccttcctcaagtgcctctgctatgcgaaattgacggatgaggcagtggacgtgctgcttcataggatgtccgagctcgggtgtgtgcctgatgccatctcatacaacactgtcctgaagagcttatgcgacaatggcatgagccagcgggggctcgaactgctccagatgattgcaaaagaagtaggtgtctgctctctcaatctggtggcatataacacggtcatctacggcttctttaaggaaggtgaaacaggcaaggcatgcaatctattccatgaaatgatgcagcaaggtgttgagcccgatgtggtgacttacaacttgatcattgatgctttgtgcaaggccagagcaatggacaaggcagaagtagtccttcagcagatgatcagtaaaggtgctcaacctcatacagtgacatataattgcatgatcaatggatatgccacatctgggcggttgaaaaagtctgctaaaatgttcagagaaatgaaaagccggggtcttatgccagatattgttacttgcaactccttcctgtcctccctttgcaagcatggaagaagcaaagaagctagagaaatatttgattccatgaccgccaagggccacaaaccggatatcgtctcataccgtattttgcttcatgggtatgccagtgaaggatgctttgctgatatgattgatctctttaattcaatgaaaagcaatggtattgcagctgactgccgtgttttcaccatattaattggtgcctatgctaaacacggaatgatggatgatgcaatgctcatatttacggaaatgcagcaacaaggtctgagtccaaatgtagtgacatattcaactgtaatatcagcactttctagaatgggtaggttggccaatgctatggagaaatttaatcagatgatttccatgggggttcaaccgaacaaagctgtttatcacaccctaattcagggctcttgtatgcatggtgatttgattaaagccaaggagctggtttctgaaatgatgaacaaaggtattcctcgtcctagcattacgttcttcggttcaataataaacagtttatgcaaagatggaagggttatggatgcacatgatatctttgacttggttatagacataggtgagaggcctagtgccattacatttaattcactggttgacggatattgcttagttggcaagatggataaagcatttggaatgcttaatgccatggaatcactggta

SEQ ID NO: 2210 - DNA, 1779 bp, Triticum aestivum; identical to SEQ ID NO: 2206

SEQ ID NO: 2211 - DNA, 1587 bp, Triticum aestivum
atggtgagcatcggcgagcatgctcgtcctcctaactctgctttccttctacctaatcccagttcatgcccaggttgcgccggtgcggtggggggcgagcggcgccggcgtcctctgggtcctctgccattaccagattcttccagatccataggtggagctatgagccgccgcgccgtccccgctggcaggcgcatcttggagcagaacatcaaggcccggtaccgggctggagccattggcaccgacgatgcactccacctgtttgacgaattgctccaggttgcctggccctcctcaatcgccgccatcaactgcctcctcattgtcgtcggccgtgattgccctgcgctcgtcgtctccctcttcaaccacatcgcaagagccaaggtggcgccccacaatatcacctacgtcattctagtcgactgctgcagccgtgctggccgcttggaccttggcttcgctgccatgggccacattgttaagacgggatttgcggcaggatctgttgtctctttcagccacctgctcagggccgtctgtgcggagaagaagaccagctacggaatggacatcgtgctccgaattatgcctgagcttaactgcataccggatgtttactcctacagcattcttttcaagggcctctgcaacgagaagagaagccaagaggctctcgagctgattcacgtgatggttgagcacggaggtagctgccaacctaatctggtctcatataacaccgtaattgatggcttgttgaaagagggtgaggtgggcaaggcttacagcctattttgtgaaatggtacagagcgggattttggcaaatattgtgacctacaactcaatcatctttggcatgtgcaaggttcatgcaatggacaaggctgagaaggttcttcaacagatgtttgatagagaaattctgccagatactgccacatatactagcctaatacatggatattattcatcaggacaatgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggcaaatgggagaaggttcatgaactattttctgaaatgttgaatcgcaccagcacaggcataagatcatcgaggcaacgt

SEQ ID NO: 2212 - DNA, 1470 bp, Triticum aestivum
atggtgagcatcggtgagcatgctcgtcctcctaactctgctttcattcttcctaatcccagttcatgcccaggttgcgccggtgcggtggggggcgagcggcgccggcgtcctctgggtcctctgccattaccagattcttccagatccataggtggagctatgagccgccgcgccgtccccgctggcaggcgcatcttggagcagaacatcaaggcccggtaccgggctggagccattggcaccgacgatgcactccacctgtttgacgaattgctccaggttgcctggccctcctcgatcgccgccatcaactgcctcctcattgtcgtcggccgtgattgccctgcgcccgccgtctccctcttcaaccacatcgcaagagccaaggtggcgccccacaatatcacctacggcattctagtcgactgctgcagccgtgctggccgcttggaccttggcttcgctgccatgggccacatcgttaagacgggatttgcggcaggatccgttgtctctttcagccacctgctcagggccgtctatgcgaagaagaagaccagctacggaatggacatcgtgctccgaattatgcctgagcttaactgcataccggatgtttactcctacagcattcttttcaagggcctctgcaacgagaagagaagccaagaggctctcgagctgattcacgtgatggttgagcacggaggtagctgccaacctaatctggtctcatacaacaccgtaattgatggcttgttgaaagagggtgaggtgggcaaggcttacagcctattttgtgaaatggtacagagcgggattttggcaaatattgtgacctacaactcaatcatctttggcatgtgcaaggttcatgcaatggacaaggctgagaaggttcttcaacagatgtttgatagagaaattctgccagatactgccacatatactagcctaatacatggatattattcatcaggacaatgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgatttgatggtagaraatggtatctcaccagatcatcatgtctacaacatactcatatctgcatatgctaaagaggaaatggcaagtgaggtaatgcatatatttacaaaaatgcggcagcaaggattgaaccctagtgttgcgtatatccgacacacgcaactcgtgtgcctgacgggaagtgctatgtcgacacacggcccgccgaggtgttcttcctgtggtttgagcataactttgagatgtttc

SEQ ID NO: 2213 - DNA, 1755 bp, Triticum aestivum
  misc_feature (1391)..(1391): n is a, c, g, or t
atggtgagcatcggcgagcatgctcgtcctcctaactctactttccttcttcctaatcccagttcatgcccaggttgcgccggtgcggtggggggcgagcggcaccggcgtcctctgggtcctctgccattaccagattcttccagatccataggtggagctatgagccgccgcgccgtccccgctggcaggcgcatcttggagcagaacatcaaggcccggtaccgggctggagccattggcaccgacgatgcactccacctgtttgacgaattgctccaggttgcctggccctcctcgatcgccgccatcaactgcctcctcattgtcgtcggccgtgattgccctacgctcgccgtctccctcttcaaccacatcgcaagagccaaggtggcgccccacaatatcacctacggcattctagtcgactgctgcagccgtgctggccgcttggaccttggcttcgctgccatgggccacatcgttaagacgggatttgcggcaggatccgttgtctcttttagccacctgctcagggccgtctgtgcggagaagaagaccagctacggaatggacatcgtgctccgaattatgcctgagcttaactgcataccggatgtttactcctacagcattcttttcaagggcctctgcaacgagaagagaagccaagaggctctcgagctgattcacgtgatggttgagcacggaggtagctgccaacctaatctggtctcatacaacaccgtaattgatggcttgttgaaagagggtgaggtgggcaaggcttacagcctattttgtgaaatggtacagagcgggattttggcaaatattgtgacctacaactcaatcatctctggcatgtgcaaggttcatgcaatggacaaggctgagaaggttcttcaacagatgtttgatagagaaattctrccagatactgccacatatactagcctaatacatggatattattcatcaggacaatgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtttgttactacatacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgcnttccagtattggcagaatggatgatgctatgccccaattcaatcaaatgatagccgaaggattagctcctgatatcatagttttcaacccccttattagacgaagcaaccatcatttcactcttctctctcagcttcctctctacccaaccctcgcttctccctcatcttgttcctcatttcttcaagaaaaccctgacctgcttctgccattgttcttctctcccaaagaaggaaaggtgagcgcatcaatggtgttgattctggccaaggcccggtcttgcaaccccgagactgatcctataactccctctcttttcttcttttgggtttgtgattatggtttcttttcttttatttctatt

SEQ ID NO: 2214 - DNA, 1653 bp, Triticum aestivum
atggtgagcatcggtgagcatgctcgtcctcctaactctgctttcattcttcctaatcccagttcatgcccaggttgcgccggtgcggtggggggcgagcggcgccggcgtcctctgggtcctctgccattaccagattcttccagatccataggtggagctatgagccgccgcgccgtccccgctggcaggcgcatcttggagcagaacatcaaggcccggtaccgggctggagccattggcaccgacgatgcactccacctgtttgacgaattgctccaggttgcctggccctcctcgatcgccgccatcaactgcctcctcattgtcgtcggccgtgattgccctgcgcccgccgtctccctcttcaaccacatcgcaagagccaaggtggcgccccacaatatcacctacggcattctagtcgactgctgcagccgtgctggccgcttggaccttggcttcgctgccatgggccacatcgttaagacgggatttgcggcaggatccgttgtctctttcagccacctgctcagggccgtctatgcgaagaagaagaccagctacggaatggacatcgtgctccgaattatgcctgagcttaactgcataccggatgtttactcctacagcattcttttcaagggcctctgcaacgagaagagaagccaagaggctctcgagctgattcacgtgatggttgagcacggaggtagctgccaacctaatctggtctcatacaacaccgtaattgatggcttgttgaaagagggtgaggtgggcaaggcttacagcctattttgtgaaatggtacagagcgggattttggcaaatattgtgacctacaactcaatcatctttggcatgtgcaaggttcatgcaatggacaaggctgagaaggttcttcaacagatgtttgatagagaaattctgccagatactgccacatatactagcctaatacatggatattattcatcaggacaatgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgctttccagtattggcagaatggatgatgctatgtcccaattcaatcaaatgatagccgaaggattagctcctaatatcatagttttcaacccccttattagtggtttttgtacttgtggcaaatgggagaaggttcatgaactattttctgaaatgttgaatcgcggcacctatcctgataccgtgttcttcaccacaattatggaccgcctttgcaaaaatggaagggttatggaagcccaagatatgtttggcctgatgatc

SEQ ID NO: 2215 - DNA, 1740 bp, Triticum aestivum
atggcgcacccgcccagcaaatcgaatcccagtcgcgccgagctccaaatcgaatctgaaattccccaatcccacacctccgtccgccgtcctccctccgctggacgcgcccgtggttggtcctcgccggcgcgggaccgcactcaccatcgcctcaggaagaagcgagcgagacccctctgtccagtgtctcctccgtccgtcctcctcccgccagggcttcaggtcgttgccgccagcattcaccgctgctgcagaaagacggcgacaatgtcacgccttcaggtccgctctttctccagccccgtttcctcacgcgccaacgatctgctgaccgaactccacggccatttgggcttcgggacgctcaggccagagctcgcgcaccaactgttcgacgaaatgctgcgccaacctgtcctagtatcagctcgtgcactcagcggcttatttgctgcacttgcgcgtgcgccgccctcacctgcctgcaccgatggctctgccctcgccattgatctcttcaactgcatggcccgagcaggccgtcgccaggcgacagtacccaccatttacacctacagcatactgattgagtgttgccaccgaacatgccgcccagacctagggcttgccttcttcggccgcctcctcaagacaggcatcccgacggacatcattacctacagcaacctattcaagtgcctctgtgacatgaagcgcacagaggaggctctgaacgtgctgctccataggatgcccgatgacctgcctaatgtcatctcctactcagtaattctcaagagcttctgcgacaatgggaggagccagcttgcgcttgatctgctccagatgatggccaaaaaaggtgctaaccactctcccgacgtgatgtcatacaacatggtaattgatggcttctttaaggagggagaatcaagcaaagcatgtgatctgttccatgaattgatgcagcagggggttgtgcccgatgtggtgatgtgtacctccatcatcaatgcgctatgcaaagcaagagcaatggacaaggcagaggtggttcttcgatcaatggttcataatggtgtccaaccagatgttgtgacatataatagcttgatccaaggatattcaactctgggacagttgaaagaacttgctaggttgttgaaagtgatgagaagccaaggtgttatgccatgcgttgctacctacaactcactcatgacctgcctttgcaagaatggaagattcaaggaagctgtagaaattttttattcgatggctgtgaagggccaaaaacctgatgtcgcctcatactctataatactccatggatacgctaaagaaggatcccttgttgacatgattgatctctgtcagttgatggcagcaaacggagtcatacctgacctccattgtttcaacatactaattgctacatatgctgaatatggaatgacagatgtggctatgcttttcttcgaagagatgttgaagcagggggtgcaccctaatgaagtcacatatttatctgtgatagctgggttatgcaaaacgggcaggatggatgatgctacggaaaaactcggtgagatgattgataggggagtaccacctgacaaaactgtttacatgtgcatgatggagggttattttaaacatggtgattccctgaaagccaaggaatttattaccaaaatgaagaacaaggatattcctcataggtcgcagaagggtaat

SEQ ID NO: 2216 - DNA, 912 bp, Triticum aestivum
atgcaaagaaggaagggttatgaatgcacaagtatctttgacttggttataggcatgggcgagaggcctaatgtcattacattcagttcactgattgacggatatggcttagtcggccagatgggtaaagcacttggagtgcttgatgccatggtatcagctggcattgagcctaatgttgttacgtatagttcacttcttgatggctattgtaaaaatggaaggatcaatgatgctttgattctgttcagagaaatgccacacaagagaattaaacctaacactgttacatatggcgtcatgctggatgggttgttccgtgctggcagaactgttgctgcaagggaaatgttccatgagatgaccgaaaggggtataccagtgagcatttccatatacaatataatacttggtggtctttgtagaaataattgtgcagacgaagcgatcgcactattccagaaattaggagcaaggaatgtcaagttcgatattataacactcaataccatgattaatgcaatgttcaaggttcggagaagagaagaagctaacgatttgtttgctgcaatatcagccagtgggttggtgcctgatgcttctacttacggtataatgatagaaaatattctaaaggaaggatcagtggaagaagttgacaatatgttttcatcaatggagaagagtggttgtgcacccagctctcgtcttataaattatgtcatcagaatgttgttggaaaaaggtgagattgccagggccgggaattatttatctaaagttgatgggaagatcatctcacttgaagcttcaactacttctttgttgttgtctctcttttcaagggaagggaaataccgggaaaacattgaactgcttcctgcaaagtatcaatttttcaatggatttggt

SEQ ID NO: 2217 - DNA, 912 bp, Triticum aestivum; identical to SEQ ID NO: 2216

SEQ ID NO: 2218 - DNA, 1707 bp, Triticum aestivum
atgatgcaccaaggtgttgagcccagtgtgtggacatatagctcaatcattgatgcattgtgcaaggccagagcaatggacaaggcagagctagtgcttcagcagatggttaacaaaggtgttcaacccaataatgtgacatataattgcatgatccatggatattccacatctgggaggtggaaagaggctgctaaattgtttagagaaatgaaaagccggggccttataccagatacttttacttgcaacgccttaatgacttacctttgtaagcatggaagaagcaaagaagctgcagaattttttgatgccatgactgccaaaggccacagaaatgtcaactcctactgtattttgcttcatgggtatgccaatgaaggatgctttgctgatatgattgatctctttaattcaatggaaagcaatggttttgtagccgactgccatgttttcaccatattaattgatgcatatgctaaacgtggaatgatggatgaagctatgctcatatttactgaaatgcgggaaaaaggagtgagtcccaatgtagtcacctattccactgtaatagccgcactttgcagattgggtaggctgtccgatgctatggacaggttcaatgagatgactgatatgggtgtacagccgaacacagctgtttatcgctccctaattcagggtttttgtatgcttggtgatttggttaaagttaaggaatttgtttctgaaatgatgaacaaaggtattcctcgtcctgacattgcgttcttcacttcagtaataaactctttatgcaaagaaggaagggttatgaatgcacaaggtatctttgacttggttataggcatgggcgagaggcctaatgtcattatattcagttcactgattgacggatatggcttagtcggccagatgggtaaagcacttggagtgcttgatgccatggtatcagctggcattgagcctaatgttgttacgtatagttcactacttgatggctattgtagaaatggaaggatcaatgatgctttgattctgttcagagaaatgccacacaagagaattaaacctgacactgttacatatggcatcatgctggatgggttgttccgtgctggcagaactgttgctgcaagggaaatgttccatgagatgaccgaaaggggtataccagtgagcatttccatatacaatataatacttcgtggtctttgtagaaataattgtgcagacgaagcgatcgcactattccagaaattaggagcaaggaatgtcaagttcgatattataacactcaataccatgattaatgcaatgttcaaggttcggagaagagaagaagctaacgatttgttttctgcaatatcagccagtgggttggtgcctaatgcttctacttacggtataatgatagaaaatattctaaaggaaggatcagtggaagaagttgacaatatgttttcatcaatggagaagagtggttgtgcacccagctctcgtcttataaattatgtcatcagaatgttgttggaaaaaggtgagattgccagggccgggaattatttatctaaagttgatgggaagatcatctcacttgaagcttcaactacttctttgttgttgtctctcttttcaagggaagggaaataccgggaaaacattgaattgcttcctgcaaagtatcaatttttcaatggatttggt

SEQ ID NO: 2219 - DNA, 1707 bp, Triticum aestivum; identical to SEQ ID NO: 2218

SEQ ID NO: 2220 - DNA, 912 bp, Triticum aestivum; identical to SEQ ID NO: 2216

SEQ ID NO: 2221 - DNA, 912 bp, Triticum aestivum; identical to SEQ ID NO: 2216

SEQ ID NO: 2222 - DNA, 1707 bp, Triticum aestivum; identical to SEQ ID NO: 2218

SEQ ID NO: 2223 - DNA, 1338 bp, Triticum aestivum
atgctgcgccaacccgtcccggtttcagcacgcgcactcggcggcttattttctgccctcgcgcgtgcgccgccctcaaccgcctgtactgatggccccgccctcgccatcgatctcttcaactgcatgacccgagtaagccgccgccgggtgatagcacctgacatttacacctacaacatactaattgactgctgccacaaagcatgccgcccagacctagggcctgccttcttcggctgcctcctcaagacaggcatcacaatgagcgtcattacctacagcagcttattcaagtgcctctgtgacatgaagcgcacagacgaggctttggacgtgctgctccacaggatgcccgaggacctgcctgatatcatctcctactcagtaattctcaagagcttctgcgacaacggaaggagccagtgtgcgcttgacctgctccggatgatggccaaaaaaggtactgaccattcccccaacgtggtgtcatacaacttggtaatcgatggcttctttaaggaaggtgaaggaagcaaagcatgcgatctgttccatgaaatgatacaacaggggcctgtgcctgatgtggtgacgtatacctccgtcatcgttgcgctatgcaaagcaagagcaatggacaaggcagaggtggtccttcgacaaatggttcatgatggtgttcagccgaatactgtgacatataatagcttgatccaaggatattcaactttgggacagttgaaagaagtcgctaggttgttgaaagtgatgagaagccaaggtgttttgccaagcgctgttacttgcagctcagtcatggactacctttgcaagcatggaagaatcaaagaagctgaggaaatattttattccatggccgtgaatggccgaaaaccagatatagtgtcatactctattatgctccttgggtacgctatggaaggatcccttgttaaaatgattgatctctgtgagctgatggcaagagatggagttgtacctgacctccgttgtttcaacatactgattaatgcatatgctaagtatggcaggatggatgtggccatgcttttctttgaagacatgttgaagcagggtgtgaagcctaatgaattcacttatttaactgtgatatctgtattttgcaagatgggtaggatggatgatgcgatggaaaaattcagtgagatgattgatatgggagtaccacctgacacaaaagtttacatgtgcatggttgagggttatttgaatcttggcgattccatgaaagccaaggaatttattaccaaaatgaagaacatggatattcatcataggccgcggaaaggtaat

SEQ ID NO: 2224 - DNA, 1251 bp, Triticum aestivum
atgcgctgctgctgccgcgcgcgccgccctggcctggggcttgccttcttcggccgcctcctcaggacgggcctgaggacagacggcgtcgacgcatacgccctcatcaagtgcttctgcctcgcaaaacggacagacgaggctgtcagcgtgcggctccataggttgcctgaactcggccgtgtacctgatgctttatcatactccgttgttctgaaggtcttgtgtgacgatggcaggagccagcgagcgctcggcctgctccagatgatgtggaaagagggaggtggctgcgcccctaatgtggtggcgtatagcactgtcatccacggcttctgcaaggaaggcaaagtaagcaaggcatgcgagctgttcaatgaaatggtgcagcaaggagttaagcctaatgtggtgacatacacccaagtgattgatgcgctgtgcaaggcaagagcaatggacaaggcagagtcgttccttcggcatatggttgataatgatgttcgacccaacaacgtgacatataagtgtatcatccagggatattcctctttgggctggtgggaagaggcagtaaaaatattcagagaaacgacaagccggggtcttatactagatgatgttactcgcaactcgttcgtgtcctccctttgcaaccatggaagaagcaaggaagctgcggagattgcccatcagataattgaaaatggaacaacagtgagcatttccacatacggtataattcttggagaactttgtaggaatgattgcaccgaggaagcaatcgtactgttccacaaattaggtgcagtggatgtgaagttcgatattacaatattcaataccatgattgatgcaatgtacagggttcgaagaagagaagaagctaacattttgtttgctgcaatatctgccaatggattggtacctaatgcttctacttacagaataatgataacaaatcttttaaaagaaggatcaatggaagaagctgatcatatgttctcatcaatggagacgagtggttatgctcccagctctgttctgttaaatgatatcattagaatgttgctagaaaaaggtgagatagtcaaggctggaaattatttgtctaaagttgatgggaagagcatctcacttgaagcttcaactggtttgttgatgaggcatctattttcaacggaaggaaaatatcatgagcaaataaaatcactccctgaaaggtatcaatattttggagtcagacacagt

SEQ ID NO: 2225 - DNA, 1251 bp, Triticum aestivum; identical to SEQ ID NO: 2224

SEQ ID NO: 2226 - DNA, 1251 bp, Triticum aestivum; identical to SEQ ID NO: 2224

SEQ ID NO: 2227 - DNA, 1251 bp, Triticum aestivum; identical to SEQ ID NO: 2224

SEQ ID NO: 2228 - DNA, 1251 bp, Triticum aestivum; identical to SEQ ID NO: 2224

SEQ ID NO: 2229 - DNA, 1251 bp, Triticum aestivum; identical to SEQ ID NO: 2224

SEQ ID NO: 2230 - DNA, 1173 bp, Triticum aestivum
atgcctggcttctcctccgccgcgtcaatgtcgccactgcgcctccgcctccgcctgcacgcccgccactcctccgcctcgcaaccctcacgccgccagggatgggatccccacgccgccttcgccgccgccacggagtgtgcgcgctccggcaacctcaccccggaggacgcacataacctgttcgacgaattgctgcggcagggcaatcctgtccttgggcgccccctcaacaaccttctcgccgccctcgcccgcgcgccggcgtccagcgcctgcagagatggccccgcactcgtggtcgccctcttcagccgcatatcccaaggcgcccgcctaagggtgctgcacccaacggcctgcacctacggcatcctcatggactgcagctgccgcgcacaccgcctcgatctggcgtttgccttcttcggccgtctcctcaggacgggactgaaggcaggcgtcatagaagtcaacagtctcctcaaaggactctgccacgcaaagcgggcggatgaggccatggaagtgcttcttcacaggatgcctgagctgtttataggagtacagggcacagctgtttatcgttccctaatccagggattttgtacacacggcgatttggtgaaagcaaaggaatatgttactgaaatgatgaagaaaggtatgcctcctcctgatattatgttcttcagttcaatcatgcagaacctatgcacagaaggaagggtaatagaagcacgagatatccttgacttgatagtgcgcattggtatgaggcctgatgttttcatatttaatatactgatcggtggatactgcctagtcggcaagatggaggatgcctcaaaaatatttgatgatatggtgtcatatggtttagaaccttgtaactttacgtatggtatacttattaatggctattgcaaaaataaaaggattgatgacgggcttattctgttcaaagagatgctgcgcaagggacttaaacctacaacttttaattataacgtcatactggatggattatttctggctggacaaactgttgctgcaaaagagaagtttgatgagatggttgaatctggagtaagtgtgtgcattgatacatactctatagttcttggtggactttgtagaaatagctgcagtagcgaagcgatcaccctgttc

SEQ ID NO: 2231 - DNA, 1173 bp, Triticum aestivum; identical to SEQ ID NO: 2230

SEQ ID NO: 2232 - DNA, 1452 bp, Triticum aestivum
atgtcacgccttcaggtccgctctttctccaactctgtttcttcacacgccaacgagctgctggacaaactccaaggccatctgcactccaggacgctcaggccagacctcgtgcaccaactgttcgacgaaatgctgcgccaaccagtcccagtatcagtacgtgcactcaacggcttatttgctgcccttgcgcgtgcgccgtcctccaccatctgcaccgatgcccctgccctcgccattgatctcttcaaccgcatggcccgagcaggccgtcgccaggtgccagcacccaccattcacacctacagcatgctaattgagtgttgccagcgagcatgccgcccagacctagggcttgccttcttcggccgcctactcaagacaggcatcaagacgaatgccattacctacagcagcttactcaagtgcctctgtgacatgaagcgcacggaggaggctttgggcgtgctgctccacaggatgcccgacgacctgcctaatgccatctcctactcagtaattctcaagagtttctgcgacagtggtaggagccagcttgtgcttgacttgctccggatgatggccgaaaaaggatctgaccactctcccagcgtggtgtcatacagcttggtaatcgatggcttctttaaggagggtgaaataagcaaagcatgcaatctgctccatgaaatgatgcagcagggggttgtgcccgatgtggtgacgtataactcctttatcgatgcgctatgcaaagcaagagcaatggaaaaggcagaggtagttcttcgatcaatggttcataatggtgtccaaccaaatgctgtcacatatagtagcttgatccaaggatattcaactttgggccagttgaaagaagtcgctaggctgttgaaagcaatgagaagccaaggcagtatgccagacgttgttatttgcagctcagtcatggactacctttgcaagcatggaagaatcaaagatgccgaggaaatattttactccatggccgtgaatggccgaaaaccagatatagtctcatacactattatgctccacgggtacgctatagaaggatcccttgttaaaatgattgatctctgtgagctgatggcaagagatggagttgtacccgacctccgttgtgcatatgctaagtatggcatgatggatgtggccatgcttttccttgaagacatgttgaagcagggtgtgaagcctaatgaattcacttatttaactgtgatatctgcattttgcaagatgggcaggatggatgatgcgatggaaaaattcagtgagatgattgatatgggagtaccagttgacaccgaagtttacatgtgcatggttgagggttattttaatcatggtgattccatgaaagccgagaaatttattaccaaaatgaagaacagggatattcatcataagctgcggaaaggtaat

SEQ ID NO: 2233 - DNA, 1470 bp, Triticum aestivum
atgtcacgccttcaggtccgctctttctccaactctgtttcttcacacgccaacgagctgctggacaaactccaaggccatctgcactccaggacgctcaggccagacctcgtgcaccaactgttcgacgaaatgctgcgccaaccagtcccagtatcagtacgtgcactcaacggcttatttgctgcccttgcgcgtgcgccgtcctccaccatctgcaccgatgcccctgccctcgccattgatctcttcaaccgcatggcccgagcaggccgtcgccaggtgccagcacccaccattcacacctacagcatgctaattgagtgttgccagcgagcatgccgcccagacctagggcttgccttcttcggccgcctactcaagacaggcatcaagacgaatgccattacctacagcagcttactcaagtgcctctgtgacatgaagcgcacggaggaggctttgggcgtgctgctccacaggatgcccgacgacctgcctaatgccatctcctactcagtaattctcaagagtttctgcgacagtggtaggagccagcttgtgcttgacttgctccggatgatggccgaaaaaggatctgaccactctcccagcgtggtgtcatacagcttggtaatcgatggcttctttaaggagggtgaaataagcaaagcatgcaatctgctccatgaaatgatgcagcagggggttgtgcccgatgtggtgacgtataactcctttatcgatgcgctatgcaaagcaagagcaatggaaaaggcagaggtagttcttcgatcaatggttcataatggtgtccaaccaaatgctgtcacatatagtagcttgatccaaggatattcaactttgggccagttgaaagaagtcgctaggctgttgaaagcaatgagaagccaaggcagtatgccagacgttgttatttgcagctcagtcatggactacctttgcaagcatggaagaatcaaagatgccgaggaaatattttactccatggccgtgaatggccgaaaaccagatatagtctcatacactattatgctccacgggtacgctatagaaggatcccttgttaaaatgattgatctctgtgagctgatggcaagagatggagttgtacccgacctccgttgtttcaacatactgattaatgcatatgctaagtatggcatgatggatgtggccatgcttttccttgaagacatgttgaagcagggtgtgaagcctaatgaattcacttatttaactgtgatatctgcattttgcaagatgggcaggatggatgatgcgatggaaaaattcagtgagatgattgatatgggagtaccagttgacaccgaagtttacatgtgcatggttgagggttattttaatcatggtgattccatgaaagccgagaaatttattaccaaaatgaagaacagggatattcatcataagctgcggaaaggtaat

SEQ ID NO: 2234 - DNA, 1470 bp, Triticum aestivum
atgtcacgccttcaggtccgctctttctccaactctgtttcttcacacgccaacgagctgctggacaaactccaaggccatctgcactccaggacgctcaggccagacctcgtgcaccaactgttcgacgaaatgctgcgccaaccagtcccagtatcagtacgtgcactcaacggcttatttgctgcccttgcgcgtgcgccgtcctccaccatctgcaccgatgcccctgccctcgccattgatctcttcaaccgcatggcccgagcaggccgtcgccaggtgccagcacccaccattcacacctacagcatactaattgagtgttgccagcgagcatgccgcccagacctagggcttgccttcttcggccgcctactcaagacaggcatcaagacgaatgccattacctacagcagcttactcaagtgcctctgtgacatgaagcgcacggaggaggctttgggcgtgctgctccacaggatgcccgacgacctgcctaatgccatctcctactcagtaattctcaagagtttctgcgacagtggtaggagccagcttgtgcttgacttgctccggatgatggccgaaaaaggatctgaccactctcccagcgtggtgtcatacagcttggtaatcgatggcttctttaaggagggtgaaataagcaaagcatgcaatctgctccatgaaatgatgcagcagggggttgtgcccgatgtggtgacgtataactcctttatcgatgcgctatgcaaagcaagagcaatggaaaaggcagaggtagttcttcgatcaatggttcataatggtgtccaaccaaatgctgtcacatatagtagcttgatccaaggatattcaactttgggccagttgaaagaagtcgctaggctgttgaaagcaatgagaagccaaggcagtatgccagacgttgttatttgcagctcagtcatggactacctttgcaagcatggaagaatcaaagatgccgaggaaatattttactccatggccgtgaatggccgaaaaccagatatagtctcatacactattatgctccacgggtacgctatagaaggatcccttgttaaaatgattgatctctgtgagctgatggcaagagatggagttgtacccgacctccgttgtttcaacatactgattaatgcatatgctaagtatggcatgatggatgtggccatgcttttccttgaagacatgttgaagcagggtgtgaagcctaatgaattcacttatttaactgtgatatctgcattttgcaagatgggcaggatggatgatgcgatggaaaaattcagtgagatgattgatatgggagtaccagttgacaccgaagtttacatgtgcatggttgagggttattttaatcatggtgattccatgaaagccgagaaatttattaccaaaatgaagaacagggatattcatcataagctgcggaaaggtaat

SEQ ID NO: 2235 - DNA, 1470 bp, Triticum aestivum; identical to SEQ ID NO: 2233

SEQ ID NO: 2236 - DNA, 1470 bp, Triticum aestivum; identical to SEQ ID NO: 2233

SEQ ID NO: 2237 - DNA, 1470 bp, Triticum aestivum; identical to SEQ ID NO: 2233

SEQ ID NO: 2238 - DNA, 1626 bp, Triticum aestivum
atgcctcgcctctcctccaccacgccaatgtcaccaccacgcctccgcctccgactccgcggccgccactcctcctccacctctcatccctcacgcatctgggatccccacgccgccttcgccggcgcgacgcagcgggcgcactctggcaacctcaccccggaggacgcacaccacctgttcgacgaattgctgcggcagggcaatcctgtccaggagcgtcccttgactaactttctggctgccctcgcccgcgcgcccgcgtccgcatcctgcagcgatggccccgccctggccgtagccctcttcggtcgtttgtcccgaggcgccggacgacgcgtggcacagccaaatgtcttcacctatggcgtcctcatggactgctgctgccgcgcgtgccgcccggatctggcgctcgctttcttcggccgtctcttcaggaagggcctggaggcaaaccgagtcatcttctgcaccctcctcaagggactctgccacgcaaagcgcacagatgaggctctggacgtgctgcttcacaggatgcctgagctgggctgcacccccaacgtggtggcatataccacggtcatccacggcttctttaaggaaggccaagtaggcaaggcatgcaatctgttccatggaatggcgcagcagggcgttgcgcctaatttggtgacatataactcggttattgatgcgttgtgcaaggccaaagcaatggacaaggcagagtatttccttggtcagatggttgatgatggtgtcgtacctgataatgtgacatataatagcctcatccatggatattcctcttcaggccactggaaggaggcagttagggtattcaaagagatgacaagtcggagggttacagcagatgtgcatacttacaacatgtttatgacctttctttgcaaacatggaagaagcaaagaagctgcaggaatttttgataccatggctattaagggcctgaaacctgacaacgtttcatatgctattctccttcatgggtatgccaccgaaggatgcttagttgatatgattaatctcttcaattcaatggaaagagattgtattctacctgactgtcgtatcttcaacatactgattaatgcatatgctaaatctgggaagcttgataaggctatgcttatcttcaatgaaatgcagaaacaaggagtgagtccaaatgcagtcacatattcaaccgtaatacatacattttgcaaaaagggtaggttggatgatgctgtgataaagtttaatcagatgattgatacaggagtacgacagggcacagctgtttatggttctctaatccagggtttttgtacacacggcgatttggtgaaagcaaaggaattgcttactgaaatgatgaacaaaggtatgcttcctcctgatatcaagttcttccattcaatcatgcagaacctttgcacagaaggaagggtaatagaagcacgggatgtccttggcttgatagcgcacataggtatgaggcctgatgtttgcacatttaatatactgatcggtggatactgcctagtcggcaagatggaggatgcctcaaaaatatttgatgatatgatgtcatatggcttagaaccttctaattgt

SEQ ID NO: 2239 - DNA, 1626 bp, Triticum aestivum; identical to SEQ ID NO: 2238

SEQ ID NO: 2240 - DNA, 1611 bp, Triticum aestivum
atggttgagcatggaggtagctgccaacctaatgtggtgacctatagcaccgtgattgatggcttgttgacagagggtgaggtgaacaaggcttacagcctattttgtgaaatgttacagaggggaatttcgccgaatgttgtgacctgtagttcaatcatctctggcatgtgcaagcttcatgcgatggacaaggcggaggaggttcttcaacagatgtttgagagacgaattctgccagatgttgccacatatactagtctaatacatggatattattcattaggacagtgcaaagaggtggattggattttatgggaaatgtctagaaatggtgttcaaccagatattgtaacttacaatatacagatggattatctttgtaagagcggaaggtgcgcaaaagctaggaaaatatttgattccatggtcggtttgggccaaaaaccagatgttactacctacaacgttctgcttcatgggtatgctatggaaagatcttttcatgatatgaattgtctcattgagttgatggatgataatggtatttcaccagatcattatggctacaacatactcatatctgcttatgctaaagaaaaaatggttgatgaagtaatgcatatatttacaaaaatgcggcagcaaggactgaaccctgatgtagtgaactatggagcggcagtaaacttgctttccaagattggccgaatggatgatgctatgtcccaattcaatcaaatgataactgaagggttagctcctgatatcatagttttcaccccccttattagtggtttctgttcttgtggcaaatgggagaaggttgatgaactattttctgagatgttggatcgcggcatctgtcccaacacagtgttcttcaacacaatcatggaccgcctttgcaaaaatgaaagggttatggaagcccaagatctcttcgacctgatggtacacatgggtgtgaagcctgatgtgtgtacttataacacactgataggtggatacttgttcgttggtaagatggatgaagtgagcaagttacttgacaatatggtctcaattggcatggaaccagatgttatcacctataacatactgattgatggttactctaagaatggaaagatagatgatgcattggttgtttttagggggatgttggaaaggaaggataagccttctgttatcacttttaatattatgattggtgcgttgcttaaatgtcacaggaaggaagaagcaaaagatttgtttgacggtatctgggccaaaggattagttcctgatgttgttacatatagcttaatgatacaaaaacttatagaagaaggttctctacaagagtctgatgatctattcctttctatggagaagaatggatgtgctgccgactcccgcatgctaaatgctatagttagaagcttacttcagaaaggggatgtgcccagggctgggacttatctgtctaaaattaatgagaggagcttcacccttgaaggttccacagctaccttgttgactgcacttgcgtcaggggggagaggccaggaatataaggagttactccctgagaaataccactcttttctggaacagggcattgat

SEQ ID NO: 2241 - DNA, 1611 bp, Triticum aestivum; identical to SEQ ID NO: 2240

SEQ ID NO: 2242 - DNA, 1611 bp, Triticum aestivum; identical to SEQ ID NO: 2240

SEQ ID NO: 2243 - DNA, 1611 bp, Triticum aestivum; identical to SEQ ID NO: 2240

SEQ ID NO: 2244 - DNA, 1611 bp, Triticum aestivum; identical to SEQ ID NO: 2240

SEQ ID NO: 2245 - DNA, 1611 bp, Triticum aestivum; identical to SEQ ID NO: 2240

SEQ ID NO: 2246 - DNA, 663 bp, Triticum aestivum
atgatcgccgtgtctctcttcaaccgcctgtgccgagaagccagcccacatgcgtcgcctcttacagtccacacctacggcatcctcacggactgctgctgccgcgcgcgtcgccctgacctggggcttgccttcttcggccgcctcctcaggacgggcctgaggacagacggcgtcgacgcgtacgccctcatcaagtgcttctgcctcgcaaaacggacagatgaggctgtcagcgtgctgctccataggttgcctgaactcggctgtgcgcctgatgccttatcatactccgttgttctgaaggtcttgtgtgacgatggccggagccagcgagcgttcgacctgctccagatgatgtcgaaagaaggaggtggctgcgcccccaacgtggtggcatatagcacggtcatccacggcttctgtaaggaaggcaaagtaagcaaggcatgcgatctgttcgatgaaatggtgcagcaaggagttaagcctaatgtggtgacatatacctcgataattgatgcgctgtgcaaggccagagcaatggacaaggcagagtcgttccttcggcatatggtcgataatgatgttcgacctgctatattatctactcttttggactatattgggctttattttccacctttatattatttttgggac

SEQ ID NO: 2247 - DNA, 1629 bp, Triticum aestivum
atggcagtgatgcctcgcctccactccaccacgcccatgccccgcctcctccgccgcctctcctccacctccacctccacctcggcgccctcacgctgctgggaccccagcgccgccctcgccgcggccacggagcgcgtccgcgccgggacgctccgcccggcagacgcacaccagctgttcgacgaattgctgcagcaggcaaccccggtccctggtccagccctgaacggcttcctcgccgcccttgcccgtgctccagcctccgccgcctgcacagacagccccgccctcgccgtgtctctcttcaaccgcctgtgccgagaagccagcccacatgcgtcgcctcttacagtccacacctacggcatcctcacggactgctgctgccgcgcgcgtcgccctgacctggggcttgccttcttcggccgcctcctcaggacgggcctgaggacagacggcgtcgacgcgtacgccctcatcaagtgcttctgcctcgcaaaacggacagatgaggctgtcagcgtgctgctccataggttgcctgaactcggctgtgcgcctgatgccttatcatactccgtcgttctgaaggtcttgtgtgacgatggccggagccagcgagcgttcgacctgctccagatgatgtcgaaagaaggaggtggctgcgcccccaacgtggtggcatatagcacggtcatccacggcttctgtaaggaaggcaaagtaagcaaggcatgcgatctgttcgatgaaatggtgcagcaaggagttaagcctaatgtggtgacatatacctcgataattgatgcgctgtgcaaggccagagcaatggacaaggcagagtcgttccttcggcatatggtcgataatgatgttcgacccaacaacgtgacatataagtatatgatccagggatattcctctttgggctggtgggaagaggcagtaaaaatattcagagaaactacaagccggggtcttatactagacgatgttactcgcaactcattcgtggcctccctttgcaaccatggaagaagcaaggaagctgcagagattgcccgtcagatgattgaaactggaacaacagtgagcatttccacatatggtataattcttggagaactttgtaggaataattgcactgaggaagcaatcgtactgttccacaaattaggtgcagtgaatgtgaagtttgatattacaatattcaataccatgattgatgcaatgtacagggttcgaagaagagaagaagctaacattttgtttgctgcaatatctgccaatggattggtacctaatgcttctacttacagaataatgataacaaatcttttaaaagaaggatcaatggaagaagctgatcatatgttttcatcaatggagacgagtggttatgctcccagctccgttctgttaaatgatatcatcagaatgttgctagaaaaaggtgagatagtcaaggctggaaattatttgtctaaagttgatgggaagagcatctcacttgaagattcaactggtttgtcgatggtgcatctattttcaagagaaggcaaatatcatgagcaaataaaatcactccctgcaatctatcgatttttcggaggagtcagacacagt

SEQ ID NO: 2248 - DNA, 1632 bp, Triticum aestivum
atggcagtgatgcctcgcttccactccaccacgcccactccccgcctcctccgccgcctctcctccacctccgcctccacctcggcgcccccacgctgctgggatcccagcgccgccctcaccgcggccacggagcgcgtccgcgccgggacgctcagcccggcagacgcacaccacctgttcgacgaattgttgcagcggccaaccccggtccctggtccagccctgaacggcttcctcgcggcccttgcccgtgctccagcctccgccgcctgcagagacagcccctccctcgccgtctctatcttcaaccgcctgtgccgagaagccagcccacatggacatgcgtcgcctcttacagcccacacctacggcatcctcatgcgctgctgctgccgcgcgcgccgccctggcctggggcttgccttcttcggccgcctcctcaggacgggcctgaggacagacggcgtcgacgcatacgccctcatcaagtgcttctgcctcgcaaaacggacagacgaggctgtcagcgtgctgctccataggttgcctgaactcggccgtgtacctgatgctttatcatactccgttgttctgaaggtcttgtgtgacgatggcaggagccagcgagcgctcggcctgctccagatgatgtggaaagaaggaggtggctgcgcccctaatgtggtggcgtatagcactgtcatccacggcttctgcaaggaaggcaaagtaagcaaggcatgcgagctgttcaatgaaatggtgcagcaaggagttaagcctaatgtggtgacatacacctcagtgattgatgcgctgtgcaaggcaagagcaatggacaaggcagagtcgttccttcggcatatggttgataatgatgttcgacccaacaacgtgacatataagtgtatcatccagggatattcctctttgggctggtgggaagaggcagtaaaaatattcagagaaacgacaagccagggtcttatactagatgatgttactcgcaactcgttcgtgtcctccctttgcaaccatggaagaagcaaggaagctgcggagattgcccatcagataattgaaaatggaacaacagtgagcatttccacatacggtataattcttggagaactttgtaggaatgattgcaccgaggaagcaatcgtactgttccacaaattaggtgcagtggatgtgaagttcgatattacaatattcaataccatgattgatgcaatgtacagggttcgaagaagagaagaagctaacattttgtttgctgcaatatctgccaatggattggtacctaatgcttctacttacagaataatgataacaaatcttttaaaagaaggatcaatggaagaagctgatcatatgttctcatcaatggagacgagtggttatgctcccagctctgttctgttaaatgatatcattagaatgttgctagaaaaaggtgagatagtcaaggctggaaattatttgtctaaagttgatgggaagagcatctcacttgaagcttcaactggtttgttgatgaggcatctattttcaacggaaggaaaatatcatgagcaaataaaatcactccctgaaaggtatcaattttttggagtcagacacggt

SEQ ID NO: 2249 - DNA, 879 bp, Triticum aestivum
atgtttgacttcattctaggtattggtcggcggcctgatgtgattatgtacaattcactgatggatggatattgccttgttggcaaggtggaggaagcactgagagtacttgatgctatgaagtctgctggcctccaacctactgctgttacgtatgctatacttcttaatggctactgtaaaattggcaggatcgccgatggattgagtcttttcagggaaatgtcactcagcggggttaaacccacgacttttatgtacaacattatatttgatgggctgtttcgctccgggagagcagtttctgcaaaggaaaaattccgtacgatgactgaaagtggcataccagtgggcgttgacacatactacatagttcttcatggactttgtaaaaataattgcactggtgaagcaatagagctgttcaagaaactacgtgcaatgaacgtgaagattgatgtcataacactcaataccatgatttctgtaatgtttaaaactaggagaattgaagaagccaaggatttgtttgctactatatcagccatcggattggtgccttctgttgtgacttacagtgtaatgatgacgaatttcatagaagaagggttgctggcagaggctgatgatatgtttttagcaatggagaaggctggctgtgctcctgactcgagactgctaaatcacgtggtcagagtgttgctggagaatggtgcagttgtaaaggctgcaacttatctcgctaaacttgatgcaaaacagctgtcagttgaagcttcgacggtttcgttaatactatctctcttctcaaggaaagggaaattaagggagcatgtaaaattgcttccggtaaagtaccagcctcctgagatgttggac

SEQ ID NO: 2250 - DNA, 1602 bp, Triticum aestivum
atggttgatcaaggaattgaacccaatatcaagacatataactgtctgatccatggatattctacttttggtcagtggaaggaggcacttagggtattcaaagaaatggcaagtcttggtgttgtaccagacgttgtcacgttgacctcattaatcgattccctttgcaagcacagaaggacaaaggaagctagagaaatttttgactctatggctgcaaagggcctgaaacctaatatcgtctcctactctactatgcttaatgggtatgtcaaagaaggatccttcgaggatatgactgatctcttcaattcgatggtacggaatggtgttgtaccaaaccaccatattttcaacatactgatcaatgcatatgctaaacgtggactgatggatgaggctatgcacatgttcgaagtaatgaggcaacaaggagtaaacccagatgtagttgactatctagtaataatggattcactttgcaaaatgggtaggatggatgctgctctggacaaatttaatcagatggtcaatcaaggagtttcacctaacaaagctgtttaccaatgcctggttctgggttcttgctctcatggtcattttgtgaaagccaaggatttgatctctgaagcaattaatagaggtctgttttctaacagtgtgttcttctatcctgtaataaacgacctatgcaaagaaggaaaggtaaacgaggcacaggatatgtttgacttcattctaggtattggtcggcggcctgatgtgattatgtacaattcactgatggatggatattgccttgttggcaaggtggaggaagcactgagagtacttgatgctatgaagtctgctggcctccaacctactgctgttacgtatgctatacttcttaatggctactgtaaaattggcaggatcaccgatggattgagtcttttcagggaaatgtcactcagcggggttaaacccacgacttttatgtacaacattatatttgatgggctgttttgctccgggagagcagtttctgcaaaggaaaaattccgtacgatgactgaaagtggcataccagtgggcgttgacacatacaacatagttcttcatggactttgtaaaaataattgcactggtgaagcaatagagctgttcaagaaactacgtgcaatgaacgtgaagattgatgtcataacactcaataccatgatttctgtaatgtttaaaactaggagaattgaagaagccaaggatttgtttgctactatatcagccatcggattggtgccttctattgtgacttacagtgtaatgatgacgaatttcatagaagaagggttgctggcagaggctgatgatatgtttttagcaatggagaaggctggctgtgctcctgactcgagactgctaaatcacgtggtcagagtgttgctggagaatggtgcagttgtaaaggctgcaacttatctcgctaaacttgatgcaaaacagctgtcagttgaagcttcgacggtttcgttaatactatctctcttctcaaggaaagggaaattaagggagcatgtaaaattgcttccggtaaagtaccagcctcctgagatgttggac

SEQ ID NO: 2251 - DNA, 1602 bp, Triticum aestivum; identical to SEQ ID NO: 2250

SEQ ID NO: 2252 - DNA, 879 bp, Triticum aestivum; identical to SEQ ID NO: 2249

SEQ ID NO: 2253 - DNA, 624 bp, Triticum aestivum
atgtacaacattatatttgatgggctgtttcgctccgggagagcagtttctgcaaaggaaaaattccgtacgatgactgaaagtggcataccagtgggcgttgacacatacaacatagttcttcatggactttgtaaaaataattgcactggtgaagcaatagagctgttcaagaaactacgtgcaatgaacgtgaagattgatgtcataacactcaataccatgatttctgtaatgtttaaaactaggagaattgaagaagccaaggatttgtttgctactatatcagccatcagattggtgccttctgttgtgacttacagtgtaatgatgacgaatttcatagaagaagggttgctggcagaggctgatgatatgtttttagcaatggagaaggctggctgtgctcctgactcgagactgctaaatcacgtggtcagagtgttgctggagaatggtgcagttgtaaaggctgcaacttatctcgctaaacttgatgcaaaacagctgtcagttgaagcttcgacggtttcgttaatactatctctcttctcaaggaaagggaaattaagggagcatgtaaaattgcttccggtaaagtaccagcctcctgagatgttggac

SEQ ID NO: 2254 - DNA, 1152 bp, Triticum aestivum
atgagccgccgctttgtccccgtcgacaggcgcatcttggagcggaacatcaaggctcggtaccacgctggagacattggcaccgaggatgcactcaacctgttcgacgaattgatccaggttgctgggccttcctcagtcctcgccatcaactgcctcctcaccgttgtcggccgtgattgccccgcgctcggcgtctccctcttcaaccgtgttgcaagagccaaggtgcctccccacaatatcacctatagcattctagtcgattgctgctgccgtgctggccgcttggaccttggacacgctgccatgggacacgttattaagctgggatttgcagcagaagccatcgtcaatttcagccacctactcaaagccatctgcgccgagaagaagaccagctatgcaatggacatcgtactccggataatgcccgagtttaactgcataccaaacattttctcctataacattcttttcaagggtctctgcaacgagaagaggagccaagaggctcccgagctgattcacatcatggctgaggatggaggcagctgccaacctaatgtcgtgtcctataacaccgtaattgatggcttgttgaaagagggtgaggtgggccaggcctacagcctattttgtgtcatgctacagaggggaatttcgccgaatgttgtgacctgcacttcaatcatctctggcatgtgcaaagttcatgcgatggacaaggcagaggaggttcttcaacagatgactgatagacgaattctgccagatgttgccacatataacagtctcatacatggatattattcattaggacagtgcaaagaggttgatcggatttttaaggagatgactagaaatggtgtccaaccaaatgttgtaacttacaatatacagatggattatctttgcaagagcggaaggtgtgcggaagctaggaagatttttgattccatgatcagtttgggccaaaaaccgaccgttactacctacaacatactgcttcatgggtatgctatggaaagatcttttcatgatatgaattgtatcattgagttgatggatgataatggtatttcaccagatcattattgctacaacatactcatatctgcatataaaaaaaaaagggcaacctggtgcatg

SEQ ID NO: 2255 - DNA, 1635 bp, Triticum aestivum
atgagccgccgctttgtccccgtcgacaggcgcatcttggagcggaacatcaaggctcggtaccacgctggagacattggcaccgaggatgcactcaacctgttcgacgaattgatccaggttgctgggccttcctcagtcctcgccatcaactgcctcctcaccgttgtcggccgtgattgccccgcgctcggcgtctccctcttcaaccgtgttgcaagagccaaggtgcctccccacaatatcacctatagcattctagtcgattgctgctgccgtgctggccgcttggaccttggacacgctgccatgggacacgttattaagctgggatttgcagcagaagccatcgtcaatttcagccacctactcaaagccatctgcgccgagaagaagaccaactatgcaatggacatcgtactccggataatgcccgagtttaactgcataccaaacattttctcctataacattcttttcaagggtctctgcaacgagaagaggagccaagaggctctcgagctgattcacatcatggctgaggatggaggcagctgccaacctaatgtcgtgtcctataacaccgtaattgatggcttgttgaaagagggtgaggtgggccaggcctacagcctattttgtgtcatgctacagaggggaatttcgccgaatgttgtgacctgcacttcaatcatctctggcatgtgcaaagttcatgcgatggacaaggcagaggaggttcttcaacagatgactgatagacgaattcttccagatgttgccacatataacagtctcatacatggatattattcattaggacagtgcaaagaggttgatcggattttcaaggagatgactagaaatggtgtccaaccaaatgttgtaacttacaatatacagatggattatctttgcaagagcggaaggtgtgcagaagctaggaagatttttgattccatgatcagtttgggccaaaaaccgaccgttactacctacaacatactgcttcatgggtatgctatggaaagatcttttcatgatatgaattgtatcattgagttgatggatgataatggtatttcaccagatcattattgctacaacatactcacatctgcatatgctaaagaaaaaatggttgatgaagtaatgcatatatctacaaaaatgcggcagcaaggactgaaccctgatgtagagaactatggagcggtagtaaacttgctttccaagattggccgaatggatgatgctatgtcccaattcaatcaaatgataactgaagggttagctcctgatatcatagttttcaccccccttattagtggtttctgttcttgtggcaaatgggagaaggttgatgaactattttctgagatgttggatcgtggcatctgtcccgacacagtgttcttcaacactgttatggatcacctttgcaaaaatggaagggttatagaagcccaagatgtgttcgacctgatggtacacatgggtgtgaagcctgacgtgcgtagtcatgtcacactgatgcatggatactttgcagatggtaagatggatgaaatgaggaagttacttgaaaatatgtgctcaattggcttgaaactgatgttgtcacctatagcatac

SEQ ID NO: 2256 - DNA, 1629 bp, Triticum aestivum
atgcctcgcttctcctccagcacgccaatgtcgccaccccgcctccgcctccgactcggcggacgccactcctcctccacctctcatccctcacgcatctgggatccccacgccgccttcgccacaggcacggagcgggcggtatttggcacgctcactacggaggacgcacaccacctgttcgacgaattgctgcggcatggcaatcctgtccaggagcgctccttgaataactttctagctaccctcgcccgcgcgcccacgtccgcatcctgcagcgacggccccgccctagccgtcgccctcttcggccgtttgtcccgaggcgccggacgacgggtggcgcagccaaatgtcttcacctatggcgtcctcatggactgctgctgccgtgcgcgccgcctggatctggtgatcgccttcttcggccgtctcctcaagacgggcctggaggcagaccgagtcgttttcagcaccctcctcaagggactctgccatgcaaagcgctcagatgaggctctggacgtgctgcttcacaggatgcctgggctgggctgcacccccggcgtagtggcgtataacaccgtcatccatggcttctttaaggaaggtcaagtaggcaaggcatgcaatctatttcatgaaatggcgcagcagggcgttatgcctgatgtggtgacatatagctcggttattgatgcgctgtgcaaggccagagcaatggacaaggcagagtatttccttcgtcagatggttgatgatggtgtcgtacctaataatgtcacatataatagcctcatccatggatattcctcttcaggccattggaaggaggcagttagggtattcaaagagatgacaagtcggagggttacaccagatgtgcatacttacaacatgtttatgacctttctttgcaaacatggaagaagcaaagaagctgcaggaatttttgagaccatggctatgaagggcctgaaacctaacaacgtttcatatgctattctccttcatgggtatgccactgaaggatgcttagttgatatgattaatctcttcaattcaatgactagagatggtattcggcctaactgtcacactttgaacatactgattaatgcatatgctaaatctggcatgatggatgaggctatgcttatctttaaaggaatgcggaaacagggagtgagtccagatgtagtcacctattcaactgtaatacatgcattttgcaaaatgggtagcttggacattgctatggacaaatttaaccagatggttgatatgggagtacgaccgaatgcagttgtttatcattccctaatccagagtttttgtacacatggggatttcgtgaaagcaaaggaattggttactgaaatgaggaacaaaggtatgcgtcctcctgatattaacttcttccattcaataatgcagaacctatgcacagaaggaagggtaacagaagcacgggatatccttgacttgatagtgcacataggtatgaggcctgatgttctcatatttagtttactgatcgatggatactgcctagtctccaagatggaggatgcatcaaaaatatttgatgatatggtgtcatatggtttggaaccttctaatattacg

SEQ ID NO: 2257 - DNA, 1629 bp, Triticum aestivum
atgcctcgcttctcctccagcacgccaatgtcgccaccccgcctccgcctccgactcggcggacgccactcctcctccacctctcatccctcacgcatctgggatccccacgccgccttcgccaccggcacggagcgggcggtatttggcacgctcactacggaggacgcacaccacctgttcgacgaattgctgcggcatggcaatcctgtccaggagcgctccttgaataactttctagctaccctcgcccgcgcgcccacgtccgcatcctgcagcgacggccccgccctagccgtcgccctcttcggccgtttgtcccgaggcgccggacgacgggtggcgcagccaaatgtcttcacctatggcgtcctcatggactgctgctgccgtgcgcgccgcctggatctggtgatcgccttcttcggccgtctcctcaagacgggcctggaggcagaccgagtcgttttcagcaccctcctcaagggactctgccatgcaaagcgctcagatgaggctctggacgtgctgcttcacaggatgcctgggctgggctgcacccccggcgtagtggcgtataacaccgtcatccatggcttctttaaggaaggtcaagtaggcaaggcatgcaatctatttcatgaaatggcgcagcagggcgttatgcctgatgtggtgacatatagctcggttattgatgcgctgtgcaaggccagagcaatggacaaggcagagtatttccttcgtcagatggttgatgatggtgtcgtacctaataatgtcacatataatagcctcatccatggatattcctcttcaggccattggaaggaggcagttagggtattcaaagagatgacaagtcggagggttacaccagatgtgcatacttacaacatgtttatgacctttctttgcaaacatggaagaagcaaagaagctgcaggaatttttgagaccatggctatgaagggcctgaaacctaacaacgtttcatatgctattctccttcatgggtatgccactgaaggatgcttagttgatatgattaatctcttcaattcaatgactagagatggtattcggcctaactgtcacactttgaacatactgattaatgcatatgctaaatctggcatgatggatgaggctatgcttatctttaaaggaatgcggaaacagggagtgagtccagatgtagtcacctattcaactgtaatacatgcattttgcaaaatgggtagcttggacattgctatggacaaatttaaccagatggttgatatgggagtacgaccgaatgcagttgtttatcattccctaatccagagtttttgtacacatggggatttcgtgaaagcaaaggaattggttactgaaatgaggaacaaaggtatgcgtcctcctgatattaacttcttccattcaataatgcagaacctatgcacagaaggaagggtaacagaagcacgggatatccttgacttgatagtgcacataggtatgaggcctgatgttctcatatttagtttactgatcgatggatactgcctagtctccaagatggaggatgcatcaaaaatatttgatgatatggtgtcatatggtttggaaccttctaatattacg

SEQ ID NO: 2258 - DNA, 1629 bp, Triticum aestivum; identical to SEQ ID NO: 2257

SEQ ID NO: 2259 - DNA, 1629 bp, Triticum aestivum; identical to SEQ ID NO: 2256

SEQ ID NO: 2260 - DNA, 1629 bp, Triticum aestivum; identical to SEQ ID NO: 2257

SEQ ID NO: 2261 - DNA, 1254 bp, Triticum aestivum
atggactgctgctgccgtgcgcgccgcctggatctggtgatcgccttcttcggccgtctcctcaagacgggcctggaggcagaccgagtcgttttcagcaccctcctcaagggactctgccatgcaaagcgctcagatgaggctctggacgtgctgcttcacaggatgcctgggctgggctgcacccccggcgtagtggcgtataacaccgtcatccatggcttctttaaggaaggtcaagtaggcaaggcatgcaatctatttcatgaaatggcgcagcagggcgttatgcctgatgtggtgacatatagctcggttattgatgcgctgtgcaaggccagagcaatggacaaggcagagtatttccttcgtcagatggttgatgatggtgtcgtacctaataatgtcacatataatagcctcatccatggatattcctcttcaggccattggaaggaggcagttagggtattcaaagagatgacaagtcggagggttacaccagatgtgcatacttacaacatgtttatgacctttctttgcaaacatggaagaagcaaagaagctgcaggaatttttgagaccatggctatgaagggcctgaaacctaacaacgtttcatatgctattctccttcatgggtatgccactgaaggatgcttagttgatatgattaatctcttcaattcaatgactagagatggtattcggcctaactgtcacactttgaacatactgattaatgcatatgctaaatctggcatgatggatgaggctatgcttatctttaaaggaatgcggaaacagggagtgagtccagatgtagtcacctattcaactgtaatacatgcattttgcaaaatgggtagcttggacattgctatggacaaatttaaccagatggttgatatgggagtacgaccgaatgcagttgtttatcattccctaatccagagtttttgtacacatggggatttcgtgaaagcaaaggaattggttactgaaatgaggaacaaaggtatgcgtcctcctgatattaacttcttccattcaataatgcagaacctatgcacagaaggaagggtaacagaagcacgggatatccttgacttgatagtgcacataggtatgaggcctgatgttctcatatttagtttactgatcgatggatactgcctagtctccaagatggaggatgcatcaaaaatatttgatgatatggtgtcatatggtttggaaccttctaatattacg

SEQ ID NO: 2262 - DNA, 1551 bp, Triticum aestivum
atgcgcccatgccgcacgcctctcctcgactccacctcgccgctgtccgtgctcctcctcgaccacctccaccgcaatcgcccctcccctcccccctcagcctcgccgccgtcagccttctggtctcccatcgccgcattcgccgctgccacgaagcgcgcccgagccgggacgctcagccctgaggacgcacaccacctgttcgacgaattgctacgccagtccaacccggttcccaatcgcttcctgaacaacttccttgccgccctcgcccgtgctccaccctccgacgtctgcggagatggccccgccctcaccgtcgccctcttcaaccgcctgtgccgagaagaagccggcccttgtgtagcgccgcccactatctatacctacagcattctaatggacagctgctgccgcgtgggtcgcccggaccttgggcttgctgtcttcggacgcctactcaagtcgggcttcaaggcagaccagatcactgccagcagcctcctcatgtgcctctgcgatgtaggacagacaaacgagcctgtggacgtgctgcttcgtaggatctccaagctcggctgtgagcctaatgtcatcccatacaacatagttcttaagagcttatgtgacagtagaaggagccagcaagctcttgacctgctcctgatgatggcacaaagaggttgccgctcccctgatgtggtgtcatataacatcgtcattcatggcttatttaaggaaggtgaagtaagcatggcgtgctcattattctatgaaatgatgcggcaaagggttatgcctaatgtggtgacatatagatcgatgattggtgcgttgtgcaaggtcggggcaacggacaaggcaaagatggtccttggtcatatggttggtaatggttttcgaccagatatgtatacttggaactcattcatggcatctctttgcaagcagggaagaagcaaggaagctgcacaactttttgattacatggtcgccaagggctacaaacctgatgttgtcacgtactctactctgcttcatgggtatgctactgaaggatgcttcactgatatgattaatctctttaattcaatggaaggcaacggtattgtagctaacagctgtgtttttaacatactaattgacgcatatgctaaacgtggaatgatgcatgaagctatgctcatatttactgaaatgcgggaacgaagagtgagtcctgatatattcacctatggaattataatagctgcactttgcagaatgggtaggctatctgatgctatggagaaaataaatgaaatggttgctgcaggattacaaccggacaaggctgtttactattccctaattcagggtttttgtacacatgatgatttggtcaaagctaaggagttggtttctgagatgatgaccaaaggtattcctcgtcctaacattgtgttcttcaactcggtaatagccagtctgtgcaaagaaggaagggttaaggatgcacacggtatctttgacttggctatgaacattggtgagaggcccgatttaattcac

SEQ ID NO: 2263 - DNA, 804 bp, Triticum aestivum
atgtcgctgctccgtctccgcctccgcctccatgcccgccgctcctactccacctcgcatcccccacgcagccagggctgggatccccacgccgccttcgctgctgccacggagcgcgcgcgatctggcaatctcacctcggaggacgcacacaagctgttcgaccaattgctcctgcaggctaatccggtcaacatgcgccttcccaacgaccttctcaccgccctggctcgcgcgcctgcgttcgcagcctgcagcaacggccccgccctcgccgtcgccctcttcagccgtttgtcccaaagtgcccgccaacgggtggtgcagccaacggcctgcacccacggcatcctcatggactgctgctgccgcgcacaccgcctggatctggcgctcgccttcttcgcccgtctcctcaggacgggactcaaggcaggcgtcatagaagtcaacactcttctcaagggactctgccgcgcaaagcgggctgatgaggctctggacattctgcttcacaggatgcctgagctgggctgcacccccaacgtggtggcatataccacggtcatccacggcttctttaaggaaggccaagtaagcaaggcatgcaatctattccatgaaatggcgctgcagggcgttacacctgatgtggtgacatataactcggttattgatgcgctgtgcaaggccagagccatggacaaggcagagtatttccttggtcagatggttgatgatggtgtcgtacctgataatgtgacatataatagcctcatccatggatattccttttcaggccac

SEQ ID NO: 2264 - DNA, 1557 bp, Triticum aestivum
atgtcgctgctccgtctccgcctccgcctccatgcccgccgctcctactccacctcgcatcccccacgcagccagggctgggatccccacgccgccttcgctgctgccacggagcgcgcgcgatctggcaatctcacctcggaggacgcacacaagctgttcgaccaattgctcctgcaggctaatccggtcaacatgcgccttcccaacgaccttctcaccgccctggctcgcgcgcctgcgttcgcagcctgcagcaacggccccgccctcgccgtcgccctcttcagccgtttgtcccaaggtgcccgccaacgggtggtgcagccaacggcctgcacccacggcatcctcatggactgctgctgcaacgcacaccgcctggatctggcgctcgccttcttcgcccgtctcctcaggacgggactcaaggcaggcgtcatagaagtcaacactcttctcaagggactctgccgcgcaaagcgggctcatgaggctctggacattctgcttcacaggatgcctgagctgggctgcacccccaacgtggtggcatataccacggtcatccacggcttctttaaggaaggccaagtaagcaaggcatgcaatctattccatgaaatggcgctgcagggcgttacacctgatgtggtgacatataactcggttattgatgcgctgtgcaaggccagagccatggacaaggcagagtatttccttggtcagatggttgatgatggtgtcgtacctgataatgtgacatataatagcctcatccatggatattccttttcaggccactggaaggaggctgttagggtattcaaacagatgacaagtcggagggttacagcagatgtgcatacttacaacatgtttatgacctttctttgcaaacatggaagaagcaaagaagctgcaggaatttttgataccatggctatcaagggcctgaaacctgacaacgtttcatatgctattctccttcatgggtatgccaccgaaggatgcttagttgatatgattaatctcttcaattcaatggaaagagattgtattctacctgactgtcgtatcttcaacatactgattaatgcatatgctaaatctgggaagcttgataaggctatgcttatcttcaatgaaatgcagaaacaaggagtgagtccaaatgcagttacatattcaactgtaatagatgcattttgcaaaaagggtcagttggacgatgctatgataaagtttaatcagatgattgatacaggaatacgacagggcacaactgtttatggtttttgtacacacggcgatttggtgaaagcaaaggaattgcttactgaaatgatgaacaaaggtatacctcctcctgatattaagttcttccattcaatcatgcagaaccttggcacagaaggaagggtaatagaagcacgggatgtccttggcttgatagcgcacataggtatgaggcctaatgtttgcacatttaatatactgagcggtggatattgcctttcggcaagatggaggatgcctcaaaaatatttgatgata

SEQ ID NO: 2265 - DNA, 738 bp, Triticum aestivum
atgacaagtcggagggttacagcagatgtgcatacttacaacatgtttatgaactttctttgcaaacatggaagaagcaaagaagctgcaggaatttttgataccatggctatcaagggcctgaaacctgacaacgtttcatatgctattctccttcatgggtatgccaccgaaggatgcttagttgatatgattaatctcttcaattcaatggaaagagattgtattctacctgactgtcgtatcttcaacatactgattaatgcatatgctaaatttgggaagcttgataaggctatgcttatcttcaatgaaatgcagaaacaaggagtgagtccaaatgcagttacatattcaactgtaatagatgcattttgcaaaaagggtcagttggacgatgctatgataaagtttaatcagatgattgatacaggaatacgacagggcacaactgtttatggttctctaatccagggtttttgtacacacggcgatttggtgaaagcaaaggaattggttactgaaatgatgaacaaaggtatacctcctcctgatattaagttcttccattcaatcatgcagaaccttggcacagaaggaagggtaatagaagcacgggatgtccttggcttgatagcgcacataggtatgaggcctaatgtttgcacatttaatatactgagcggtggatattgcctttcggcaagatggaggatgcctcaaaaatatttgatgata

SEQ ID NO: 2266 - DNA, 1659 bp, Triticum aestivum
atggtgagcatcggcgagcatgctcgtcctcctaactctgctttccttcttcctaatcccagttcatgcccaggttgcgtcggtgcggtggggggcgagcggcaccggcgtcctctaggtcctctgccattaccagattcttccagatccataggtggagctatgagccgccgcgccgtccccgctggcaggcgcatcttggagcagaacatcaaggcccggtaccgggctggagccattggcaccgacgatgcactccacctgtttgacgaattgctccaggttgcctggccctcctcgatcgccaccatcaactgcctcctcattgtcgtcggccgtgattgccctgcgctcgccgtctccctcttcaaccacatcgcaagagccaaggtggcgccccacaatatcacctacggcattctagtcgactgctgcagccgtgctggccgcttggaccttggcttcgctgccatgggccacatcgttaagacgggatttgcggcaggatccgttatctctttcagccacctgctcagggccgtctgtgcggagaagaagaccagctacggaatggacatcgtgctccgaattatgcctgagcttaactgcataccggatgtttactcctacagcattcttttcaagggcctctgcaacgagaagagaagccaagaggctctcgagctgattcacgtgatggttgagcacggaggtagctgccaacctaatctggtctcatacaacaccgtaattgatggcttgttgaaagagggtgaggtgggcaaggcttacagcctattttgtgaaatggtacagagcgggattttggcaaatattgtgacctacaactcaatcatctctggcatgtgcaaagaggtggaacgggttttcgagcacatgtctataaatggtgttcaaccaaatatgataacttacaatatacagatggattatcttcgcaagagcggaagatgcgcggaagctaggaagatctttgattctatggtcagtttgggccaaaaaccgtatgttactacctacagtattctgcttaatggttatgttatggaaaaatcatttcatgatatgcattgtctccttgatttgatggtagaaaatggtatcttaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgcattccagtattggcagaatggatgatgctatgccccaattcaatcaaatgatagccgaaggattagctcctgatatcatagttttcaacccccttattagtggtttttgtacttgtggcaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatatgctctcaattggctcgaaaccggat

SEQ ID NO: 2267 - DNA, 1659 bp, Triticum aestivum
atggtgagcatcggcgagcatgctcgtcctcctaactctgctttccttcttcctaatcccagttcatgcccaggttgcgccggtgcggtggggggcgagcggcgccggcgtcctctgggtcctctgccactaccagattcttccagatccataggtggagctatgagccgccgcgccgtccccgctggcaggcgcatcttggagcagaacatcaaggcccggtaccgggctggagccattggcaccgacgatgcactccacctgtttgacgaattgctccaggttgcctggccctcctcgatcgccgccatcaactgcctcctcattgtcgtcggccgtgattgccctgcgctcgccgtctccctcttcaaccacatcgcaagagccaaggtggcgccccacaatatcacctacggcattctagtcgactgctgcagccgtgctggccgcttggaccttggcttcgctgccatgggccacatcgttaagacgggatttgcggcaggatccgttgtctctttcagccacctgctcagggccgtctgtgcgaagaagaagacaagctacggaatggacatcgtgctccgaattatgcctgagcttaactgcataccggatgtttactcctacagcattcttttcaagggcctctgcaacgagaagagaagccaagaggctctcgagctgattcacgtgatggttgagcacggaggtagctgccaacctaatctggtctcatacaacaccgtaattgatggcttgttgaaagagggtgaggtgggcaaggcttacagcctattttgtgaaatggtacagagcgggattttggcaaatattgtgacctacaactcaatcatctctggcatgtgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcagcaaggatcgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggaaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatgtgctctcaattggctcgaaaccggat

SEQ ID NO: 2268 - DNA, 1659 bp, Triticum aestivum
atggtgagcatcggcgagcatgctcgtcctcctaactctactttccttcttcctaatcccagttcatgcccaggttgcgccggtgcggtggggggcgagcggcaccggcgtcctctgggtcctctgccattaccagattcttccagatccataggtggagctatgagccgccgcgccgtccccgctggcaggcgcatcttggagcagaacatcaaggcccggtaccgggctggagccattggcaccgacgatgcactccacctgtttgacgaattgctccaggttgcctggccctcctcgatcgccgccatcaactgcctcctcattgtcgtcggccgtgattgccctgcgctcgccgtctccctcttcaaccacatcgcaagagccaaggtggcgccccacaatatcacctacggcattctagtcgactgctgcagccgtgctggccgcttggaccttggcttcgctgccatgggccacatcgttaagacgggatttgcggcaggatccgttgtctctttcagccacctgctcagggccgtctgtgcgaagaagaagacaagctacggaatggacatcgtgctccgaattatgcctgagcttaactgcataccggatgtttactcctacagcattcttttcaagggcctctgcaacgagaagagaagccaagaggctctcgagctgattcacgtgatggttgagcacggaggtagctgccaacctaatctggtctcatacaacaccgtaattgatggcttgttgaaagagggtgaggtgggcaaggcttacagcctattttgtgaaatggtacagagcgggattttggcaaatattgtgacctacaactcaatcatctctggcatgtgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcagcaaggatcgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggaaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatgtgctctcaattggctcgaaaccggat

SEQ ID NO: 2269 - DNA, 1659 bp, Triticum aestivum
atggtgagcatcggcgagcatgctcgtcctcctaactctgctttccttcttcctaatcccagttcatgcccaggttgcgtcggtgcagtggggggcgagcggcaccggcgtcctctgggtcctctgccattaccagattcttccagatccataggtggagctatgagccgccgcgccgtccccgctggcaggcgcatcttggagcagaacatcaaggcccggtaccgggctggagccattggcaccgacgatgcactccacctgtttgacgaattgctccaggttgcctggccctcctcgatcgccgccatcaactgcctcctcattgtcgtcggccgtgattgccctgcgctcgccgtctccctcttcaaccacatcgcaagagccaaggtggcgccccacaatatcacctacggcattctagtcgactgctgcagccgtgctggccgcttggaccttggcttcgctgccatgggccacatcgttaagacgggatttgcggcaggatccgttgtctctttcagccacctgctcagggccgtctgtgcgaagaagaagacaagctacggaatggacatcgtgctccgaattatgcctgagcttaactgcataccggatgtttactcctacagcattcttttcaagggcctctgcaacgagaagagaagccaagaggctctcgagctgattcacgtgatggttgagcacggaggtagctgccaacctaatctggtctcatacaacaccgtaattgatggcttgttgaaagagggtgaggtgggcaaggcttacagcctattttgtgaaatggtacagagcgggattttggcaaatattgtgacctacaactcaatcatctctggcatgtgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcagcaaggatcgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggaaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatgtgctctcaattggctcgaaaccggat

SEQ ID NO: 2270 - DNA, 1659 bp, Triticum aestivum
atggtgagcatcggcgagcatgctcgtcctcctaactctgctttccttcttcctaatcccagttcatgcccaggttgcgtcggtgcggtggggggcgagcggcaccggcgtcctctgggtcctctgccattaccagattcttccagatccataggtggagctatgagccgccgcgccgtccccgctggcaggcgcatcttggagcagaacatcaaggcccggtaccgggctggagccattggcaccgacgatgcactccacctgtttgacgaattgctccaggttgcctggccctcctcgatcgccgccatcaactgcctcctcattgtcgtcggccgtgattgccctgcgctcgccgtctccctcttcaaccacatcgcaagagccaaggtggcgccccacaatatcacctacggcattctagtcgactgctgcagccgtgctggccgcttggaccttggcttcgctgccatgggccacatcgttaagacgggatttgcggcaggatccgttgtctctttcagccacctgctcagggccgtctgtgcgaagaagaagacaagctacggaatggacatcgtgctccgaattatgcctgagcttaactgcataccggatgtttactcctacagcattcttttcaagggcctctgcaacgagaagagaagccaagaggctctcgagctgattcacgtgatggttgagcacggaggtagctgccaacctaatctggtctcatacaacaccgtaattgatggcttgttgaaagagggtgaggtgggcaaggcttacagcctattttgtgaaatggtacagagcgggattttggcaaatattgtgacctacaactcaatcatctctggcatgtgcaaagaggtggaacgggttttcgagcacatgtctataaatggtgttcaaccaaatatgataacttacaatatacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcagcaaggatcgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggaaaatgggagaaggttcatgaactattttctgaaatgttgaatcgcggcacctatcctgataccgtgttcttcaccacaattatggaccgcctttgcaaaaatggaagggttatggaagcccaagatatgtttgacctgatggtacacgtgggtgttaagcctaatgttcatacttatgccacattgatgcatgggtactttttcgttaggaagatggatgaagtgaggaagttacttggcaatgtgctctcaattggctcgaaaccggat

SEQ ID NO: 2271 - DNA, 1530 bp, Triticum aestivum
atgatgtccgagctcggctgtgtgcctaatgccttctcatactccattgttctgaagggcttatgcgacaatagcatgtgtcagcgggcgctcgagctgctccagatgctggtggaaaaagaaggtgcctgctctctcaatgtagtggcatatagcacagtcatccatggtttctttaaggaaggcgaaaccagcaaggcgtgcaatctattcgatgaaatgatacagcaagggattgtgcctgatgtggtgacatatagctcaattattgatgcgttgtgcaaggccagggcaatggacaaatcagagctagtccttcgtcagatggttgctaatggtgctcaacccaatgaagtgacatataattgcatgatccatggatattccacatctgggcggtggaaagaggctgttaaattgtttagagaaatgaaaagccggggccttataccagatatttttacttgcaactccttaatgacttaccattgcaagcatggaagaagcaaagaagctgcagaatttttttattcgatgacagcaaagggccacaaaccggatatcgtctcataccgtattttgcttcatgggtatgctactgaaggatgctttcctgatatgattgatgtctttaattcaatggaaaacaatggtattgcagccgactgccatgttttcaacatattaattgatgcatattctaaacgtggaatgatggatgaaactatgctgataacaagtaaaatgcaggaacgcagagtgaatcctgatatagtcacctattccagcataatagctggactttccagattgggtaggctgactgaggccatggaaaaattcaatcagatgattgccttgggagtacaaccgaacaaagttgtttatcacgcgttgattcagggtttttgcatagatggtgatttggctaaagctaagcagttggtttctgaaatgatgaacagaggtattcctcgtcctaacatttcgttctttagttcagtaataaagagtctctgccaagaaggaagggttatggatgcacatgatatctttgacttggttatagacatgggtgagaggcctgatgacattttacttaattcactgattgacggatactgcttagtcgggaagatggataaagcattaaaagtacttgatgtcatggaatcagttggtgttgagcctgatgttattacatacaatacacttgttaatggctattgtagaaatggaaggatcaatgatggtttgactctgttcagagatatggcgcgtaagagaattaaacctgacactgtgttcatattgcgtcataatggatgggttgtttcgttctgggagatctgtttctgttatggcgctgctagaaggagggcgcgagagggccggccgggggcctttttgcccacggccgggcaagagggaagggatttccttcttaattcttgcttgattagattgatacatctcctctctttatatagagaggtttacttgactcccaagcaaggcttacttgacccc

SEQ ID NO: 2272 - DNA, 1530 bp, Triticum aestivum; identical to SEQ ID NO: 2271

SEQ ID NO: 2273 - DNA, 1530 bp, Triticum aestivum
atgatgtccgagctcggctgtgtgcctaatgccttctcatactccattgttctgaagggcttatgcgacaatagcatgtgtcagcgggcgctcgagctgctccagatgctggtggaaaaagaaggtgcctgctctctcaatgtagtggcatatagcacagtcatccatggtttctttaaggaaggcgaaaccagcaaggcgtgcaatctattcgatgaaatgatacagcaagggattgtgcctgatgtggtgacatatagctcaattattgatgcgttgtgcaaggccagggcaatggacaaatcagagctagtccttcgtcagatggttgctaatggtgctcaacccaatgaagtgacatataattgcatgatccatggatattccacatctgggcggtggaaagaggctgttaaattgtttagagaaatgaaaagccggggccttataccagatatttttacttgcaactccttaatgacttaccattgcaagcatggaagaagcaaagaagctgcagaatttttttattcgatgacagcaaagggccacaaaccggatatcgtctcataccgtattttgcttcatgggtatgctactgaaggatgctttcctgatatgattgatgtctttaattcaatggaaaacaatggtattgcagccgactgccatgttttcaacatattaattgatgcatattctaaacgtggaatgatggatgaaactatgctgataacaagtaaaatgcaggaacgcagagtgaatcctgatatagtcacctattccagcataatagctggactttccagattgggtaggctgactgaggccatggaaaaattcaatcagatgattgccttgggagtacaaccgaacaaagttgtttatcacgcgttgattcagggtttttgcatagatggtgatttggctaaagctaagcagttggtttctgaaatgatgaacagaggtattcctcgtcctaacatttcgttctttagttcagtaataaagagtctctgccaagaaggaagggttatggatgcacatgatatctttgacttggttatagacatgggtgagaggcctgatgacattttacttaattcactgattgacggatactgcttagtcgggaagatggataaagcattaaaagtacttgatgtcatggaatcagttggtgttgagcctgatgttattacatacaatacacttgttaatggctattgtagaaatggaaggatcaatgatggtttgactctgttcagtgatatgccgcgtaagagaattaaacctgacactgtgttcatattgcgtcataatggatgggttgtttcgttgtgggagatctgtttctgttatggcgctgctagaaggagggcgcgagagggccggccgggggcctttttgcccacggccgggcaagagggaagggatttccttcttaattcttgcttgattagattgatacatctcctctcattatatagagaggtttacttgactcccaagcaaggcttacttgacccc

SEQ ID NO: 2274 - DNA, 1530 bp, Triticum aestivum
atgatgtccgagctcggctgtgtgcctaatgccttctcatactccattgttctgaagggcttatgcgacaatagcatgtgtcagcgggcgctcgagctgctccagatgctggtggaaaaagaaggtgcatgctctctcaatgtagtggcatatagcacagtcatccatggtttctttaaggaaggcgaaaccagcaaggcgtgcaatctattcgatgaaatgatacagcaagggattgtgcctgatgtggtgacatatagctcaattattgatgcgttgtgcaaggccagggcaatggacaaatcagagctagtccttcgtcagatggttgctaatggtgctcaacccaatgaagtgacatataattgcatgatccatggatattccacatctgggcggtggaaagaggctgttaaattgtttagagaaatgaaaagccggggccttataccagatatttttacttgcaactccttaatgacttaccattgcaagcatggaagaagcaaagaagctgcagaatttttttattcgatgacagcaaagggccacaaaccggatatcgtctcataccgtattttgcttcatgggtatgctactgaaggatgctttcctgatatgattgatgtctttaattcaatggaaaacaatggtattgcagccgactgccatgttttcaacatattaattgatgcatattctaaacgtggaatgatggatgaaactatgctgataacaagtaaaatgcaggaacgcagagtgaatcctgatatagtcacctattccagcataatagctggactttccagattgggtaggctgactgaggccatggaaaaattcaatcagatgattgccttgggagtacaaccgaacaaagttgtttatcacgcgttgattcagggtttttgcatagatggtgatttggctaaagctaagcagttggtttctgaaatgatgaacagaggtattcctcgtcctaacatttcgttctttagttcagtaataaagagtctctgccaagaaggaagggttatggatgcacatgatatctttgacttggttatagacatgggtgagaggcctgatgacattttacttaattcactgattgacggatactgcttagtcgggaagatggataaagcattaaaagtacttgatgtcatggaatcagttggtgttgagcctgatgttattacatacaatacacttgttaatggctattgtagaaatggaaggatcaatgatggtttgactctgttcagtgatatgccgcgtaagagaattaaacctgacattgtgttcatattgcgtcataatggatgggttgtttcgttctgggagatctgtttctgttatggcgctgctagaaggagggcgcgagagggccggccgggggcctttttgcccacggccgggcaagagggaagggatttccttcttaattcttgcttgattagattgatacatctcctctcattatatagagaggtttacttgactcccaagcaaggcttacttgacccc

SEQ ID NO: 2275 - DNA, 1530 bp, Triticum aestivum; identical to SEQ ID NO: 2271

SEQ ID NO: 2276 - DNA, 1407 bp, Triticum aestivum
atgtccaacctccgcctcctccgccgcagctcctcctccatgtccaccaccaggtcgccactctcacgggtctggtccccccattcggcctttgccgcggccacagagcgcgtacgcaccgggacgctcagccaagacgatgcacaccacctgttcgacgaattgctgcggcaggccaccccggtccacgagcgctccctcaacagcttcctcgccgccctcgcgcatgctacgtcctctgccgcctgcatcagagatggtcgcgccctcgccatcgccctcttcaaccgcgtgtgtcgagagcaatccggcccgcgggtggtgcctctcacagtccacacgtacaacatcctcatggactgctgctgccgcgcgtctcgcccggacctaggtcttgccttcttcgctcgcctcctcaggacaggcctgaagacaaacgagatcaccgccaacaccttcctcaagtgcctctgctacgcaaaacggacggatgaggctctgaacgtgctgcttcataggatgtccgagctcggctgtgtgcctgatgccatctcatacaacattgttctgaagagcttatgtgaagatagcatgagtcagtgggcgctcgacctcctccagatgatggcgaaagaaggaggtggctgctcccccaacgtggtggcgtatagcacggtcatccatggcttttttaaggaaggtgaaacaggcaaggcatgcaatctgttccatgaaatgatgcaccaaggtgttgagcccagtgtgtggacatatagctcaatcattgatgcattgtgcaaggccagagcaatggacaaggctgagctagtgcttcagcagatggttaacaaaggtgttcaacccaataatgtgacatataattgcatgatccatggatattccacatctgggcagtggaaagaggctgctaaattgcttagagaaatgaaaagccgggaccttataccagatattgtcactcgcaactcgttcctggcctccctttgcaagcatgggagaagcaaggaagctgcagaatttcttgattccatgactgccaagggccacaaaccagatatcgtatcataccgtattttgtttcatgggtgtgccagtgaaggatgcttcgctgatatgattgatctctttaattcaatggaaagcaacggtattgcagctgactgccatgttttcaacatattaattaatggatatgcaaaacgtggaatgacagaagaagctatgctgatatttactgaaatgcggggacaaggagtgagtccagatgtagtcacctattccattgtaatagccgcactttccagaatgggtaggctgaccgatgctattgagaaattcaatgagatgactgccttggaagtacagccggacacaactgtttattgt

SEQ ID NO: 2277 - DNA, 1407 bp, Triticum aestivum; identical to SEQ ID NO: 2276

SEQ ID NO: 2278 - DNA, 1407 bp, Triticum aestivum; identical to SEQ ID NO: 2276

SEQ ID NO: 2279 - DNA, 1407 bp, Triticum aestivum; identical to SEQ ID NO: 2276

SEQ ID NO: 2280 - DNA, 1602 bp, Triticum aestivum
atgagccgccgctttccccctggagctatgagcagacgcatcttggagcggaaaattcaagatcggtaccatgccggacacattggcactcacgacgcactcaacctgttcgacgaattgatccaggttgctgggccttcctcggtccgcgccattaactgcctcctcaccgtcgtcggccgtgattgccctgcgctgggcgtctccctcttcaaccgtgttgcaagagccaaggtgcctccccacaatatcacctatagcattctagtcgattgctgctgccgtgctggccgcttggaccttggacacgctgccatgggacacgttattaagctgggatttgcagcagaagccatcgtcaatttcagccacctactcaaagccatctgcgccgagaagaagaccagctatgcaatggacatcgtactccggataatgcccgagtttaactgcataccggatgttttctcctacagcattcttttcaagggtctctgcaacgagaaaagaagccaagaggctctcgagctgattcacatcatggctgaggatggaggtagctgccaacctaatgtcgtgtcctataacaccgtacttgatggcttgttgaaagagggtgaggtgggcaaggcctacagcctattttgtgtcatgctacagaggggaatttcaccgaatgttgtgacctgcacttcaatcatctctggcatgtgcaaagttcatgcgatggacaaggcagaggaggttcttcaacagatgactaatagaggtattctgccaaatagtgccacatataatagtctgatacatggatattattcattaggacagtgcgaggaggtggatcgaattttcaaagaaatgtccagaaatggtgttcaaccagatattgtaacttataatatacagatggattatctttgcaagagcagaagatgcgcagaagctaggaagatttttgattccatggtcagtttgggccaaaaaccagatgttactacctacagcatactgcttcatgggtatgctatggaaaaatcttttcatgatatgctttgtctcattgatttgatggtaggtaatggtattgcaccaaatcattatgtctacaacatactcatatctgcatatgctaaagaagaaatggttgatgaagtaatgcatatatttagaaaaatgcggcagaaaggattgaaccctgatgcagtgagctatggaacagtaatacacttactttccaggattggtcgaatggatgatgctatgtgccagttcgctcaaatcataactgaagggttagctcctgatatcatagttttcaactcccttattagtggtttctgttcttgtggcaaatgggagaaggttcatgaactattttctgagatgttggattgcggcatctgtcccgacagagtgttcttcaacactgttatggatcacctttgcaaaaatggaagggttatggaagcccaagatgtgttcgacctgatggtacacatgggtgtgaagccttttgtccgtgattacaacacactgatacatggatactgtttagttggtaagatggatgaagggaggaagttacttgacaatatgttc

SEQ ID NO: 2281 - DNA, 1551 bp, Triticum aestivum
atgcgcccatgccggacgcctctcctcgactccacctcgcggctgtccgtgctcctcctcgaccacctccaccgcaatcgcccctcccctccgccctcaccctcgccgccgtcagccttctggtctcccatcgccgcattcgccgctgccacgaagcgcgcccgagccgggacgctcagccctgaggacgcacaccacctgttcgacgaattgctacgccagtccatcccggtccccaaccgcttcctgaacagcttccttgccgccctcgcccgtgccccagcctccgacgcctgcggagatggccccgccctcaccgtcgccctcttcaaccgcctgtgccgagaagaagccggcccttgtgtggcgccgcccactatctataccaacaacattctaatggacagctgctgccgcgtgggtcgcccggaccttgggcttgctgtcttcggccgcctactcaagtcaggcctcaaggcagaccagatcactgccagcagcctcctcatgtgcctctgcgatgtaggacggacaaacgaggctgtggacgttctgcttcataggatctccgagctcggctgtgagcctaatgtcatcccatacaacatagttcttaagagcgtatgtgacagtagaaggagccagcaagctcttgacctgctccagatgatggcacaaagaggttgctgctcccctaatgtggtgtcatataacaccgtcattcatggcttatttaaggaaggtgaagtaagcatggcgtgctcattattctatgaaatgatgcggcaaagggttatgcctaatgtggtgacatatagatcgatgattggtgcgttgtgcaaggtcggggcaacggacaaggcaaagctggtccttggtcatatggttggtaatggttttcaaccagatatgtatacttggaactcattcatggcatctctttgcaagcagggaagaggcaaggaagctgcacaactttttgattacatggtcgccaagggccacaaacctgatgttgtcatgtactccactctgcttcatgggtatgctactgaaggatgcttcactgatatgattaatcactttaattcaatggaaggcaacggtattgtagctaacagccgtgtttttaacatactaatcgacgcatatgctaaacgtggaatgatgcatgaagctatgctcatatttactgaaatgcgggaacgaagagtgagtcctgatatattcacctatggaattataatagctgcactttgcagaatgggtaggctatctgatgctatggagaaaataaatgaaatggttgctacaggattacaaccgaacgaggctgtttactattccctaattcagggtttttgtacacatgatgatttggtcaaagctaaggagttggtttctgagatgatgaccaaaggtattcctcgtcctaacattgtgttcttcaattcggtaatagccagtctgtgcaaagaaggaagggttaaggatgcacacggtatctttgacttggctatgaacattggtgagaggcccgatttaattcac

SEQ ID NO: 2282 - DNA, 1008 bp, Triticum aestivum
atgctgctccacaggatgcccggcgacatgcctgatgtcatctcctactcagtaattatcaagagcttctgtgacaacgggaggagccaacgtgcacttgacctgctccggatgatgaccaaaaagggatctgaccactcccccaatgtggtttcatacacaataatcattggtggattaattaaggagggtgaactaagcaaagcatgcgctctattccatgaaatgatgcagcagggggttgtgcctgatgtggtgacgtatagctccattatcgatgggttgtgcaaagcaagagcattggacgaggcagaggtggtccttcgacaaatgattgatagcggtgttcgaccgaatgctgtgacatacggtagcctgatccatggatattccacttcaggccagtttgaagaggtagttaggttattggaagaaatgagaggtcaaggtgtcgaaccaaatctttttactcacaacacagtcatggactacctttgcaagcatggaagaacgaaagaagctgcagaacttttttattccatggctgagaagggccataaacctaatatggtctcattctctattatgcttcatgggtacgctatagaaggatcccttgctgaaatgactgatctctgtgagctgatggcaagagacggtatcgtacccaacatctgtattttcaacatactgattaatgcatatgctaagtgtggaattatggatgtggctatgcttttcttcgaagacatgttgaagcagggagtgacccctgatgaagtcacatatttagctgtaatagctgggtattgcagaatgggcaggatggatgatgctatcaagaaattcaatgagatgattgatatgggagtaccacatagcttaactatttacaggtgcatgattcatggttattttcgtcatggcaatttcttgaaagcgaaggaattgattactgaaatgaagaacaagggtattcgtccttgtccgcgaaaaaagccaaagaat

SEQ ID NO: 2283 - DNA, 1593 bp, Triticum aestivum
atgaagttcagtgcagttccaagtttggttgagtgtctgacctccgccggtcatccaccctccagtggtttgtcgtcgccgacacgctcccacattcgccactgcaggaaggagcaagacctcccacgtctggcccggttgtcctccagctccggctcctcacaggccaaccagctgctaaacaaactcaaggatcatctgggctctgggatgctcaggccggagctcgcgcaccaactgttcgacaaattgttccctcaaaccgttccagtatcagcagatgcactcaatgtcctattttctgccctcgcgtgtgggctgccctctgccgcctgcaacgatggacctgccctcgccattgctctcttcaaacacatggcacgaacaagatgccgccaggtgatggcacccaccaatcacacttacaacacactaattgagtgctgccacatggcgcgccgccctgacataggccccgccttcttcggcctcctcctcaagacaggcatcatggtagatgtcttcaccttcaacagcttattgaagtgcctctgtgacatgaagcaaacagatgaggctctaggcgtgctgctccacaggatgcccggcgacatgcctgatgtcatctcctactcagtaattatcaagagcttctgtgacaacgggaggagccaacgtgcacttgacctgctccggatgatgaccaaaaaacgatctgaccactcccccaatgtggtttcatacacaataatcattgatggattaattaaggagggtgaactaagcaaagcatgcgctctattccatgaaatgatgcagcagggggttgtgcctgatgtggtgacgtatagctccattatcgatgggttgtgcaaggcaagagcattggacgaggcagatgtggtccttcgacaaatgattgatagcggtgttcgaccgaatgttgtgacatacggtagcctgatccatggatattccacttcaggccagtttgaagaggtagttaggttattggaagaaatgagaggtcagggtgtcgaaccaaatctttttactcacaacacagtcatggactacctttgcaagcatggaagaacgaaagaagctgcagaacttttttattccatggctgagaagggccataaacctaatatggtctcattctctattatgcttcatgggtacgctatagaaggatcccttgctgaaatgactgatctctgtgagctgatggcaagagacagtatcgtacccaacatctgtattttcaacatactgattaatgcatatgctaagtgtggaattatggatgtggctatgcttttcttcgaagacatgttgaagcagggagtgacccctgatgaagtcacatatttagctgtaatagctgggtattgcagaatgggcaggatggatgatgctatcgagaaattcaatgagatgattgatatgggagtaccacatagcttaactatttacaggtgcatcattcatggttattttcgtcatggcaagttcttgaaagcgaaggaattgattactgaaatgaagaacaagggtattcgtccttgtccgcgaaaaaagccaaagaat

SEQ ID NO: 2284 - DNA, 1008 bp, Triticum aestivum; identical to SEQ ID NO: 2282

SEQ ID NO: 2285 - DNA, 1008 bp, Triticum aestivum; identical to SEQ ID NO: 2282

SEQ ID NO: 2286 - DNA, 1008 bp, Triticum aestivum; identical to SEQ ID NO: 2282

SEQ ID NO: 2287 - DNA, 1008 bp, Triticum aestivum; identical to SEQ ID NO: 2282

SEQ ID NO: 2288 - DNA, 1008 bp, Triticum aestivum; identical to SEQ ID NO: 2282

SEQ ID NO: 2289 - DNA, 1509 bp, Triticum aestivum
atgacaaatcggagtgttacaccagatgtgtgtacttacaacttgttgatgacctccctttacaagaatggaaatagcaaagaagctgcacaattgttttattcaatggccacgaagggcctgaaacctgacaccgtttcatatgctattctccttcatgggtatgccactgaaggatgcttggttgacatgatcaatctcttcaattcaatggcaacagactgtattctacctaactgtcatatcttcaacatactgatttatgcatatgctaaatctgggaagcttgataaggctatgcttatatttaaagatatgcagaaacaaggagtgagtccagatgcagtcacatattcaaccgtaatacatgcattttgcaaaaagggtaggttggatgatgctgtgacaaagtttaatcagatgattgatacaggagtacaaccggaagcatctgcttatcgttccctaatccagggtttttgtacacatggcgatttggtgaaagcaaaggaatatgttactgaaatgatgaagaaaggtatgcttcctcctgatattatgttcttcagttcaatcatgcagaaactatgcacagaaggaagggtaatagaagcacgagatatccttgacttgatagtgcgcattggtatgaggcctaatgttttcatatttaatatactgatcggtgggtactgcctaggctgcaagatggaggatgcaacaaaaatgtttgaggatatggtgtcatttggtttagaaccttgtaatattacgtatggtatacttattaatggctattgcaaaagtagaaggattgatgatgggcttattctgttccaagagatgctgcacaagggacttaaacctacaacttttaattataatgtcatactggatgggttatttctggctggacgaactattgctgcaaaggaaaagtttgatgagatggttgaatctggagtaagtgtgtgcactgatacatattcgatagttcttgctggactttgcagaaataattgctttagcgaagtaatcatgctgttccagaagttaagggcaatgaacatgaaattcaatattagaattgtcactatcattattgatgccttctacaaggttcggcgaaaccaagaagctaaggatttgtttgctgcaataccatccaatggtttggtagctaatgttgttacctacagcataatgatgaaaaatcttataaaagaaggttcagtggaagaagctgacactctctttttatcaatggagaagagcggctgtactgcaaactcttggatgttaaatcatattatcagaaggttactggaaagaggagagatagtcaaggctggaaattatatatcgaaagttgatgcaaagagctactcacttgaagctaaaactgtttcgctgctgatctccctcttttcagggaaagggaaatatagagaacacataaaattgctccctatgaagtatcagtttctcgaagaagcagccacagttgaa

SEQ ID NO: 2290 - DNA, 915 bp, Triticum aestivum
atgacaaatcggagtgttacaccagatgtgtgtacttacaacttgttgatgacctccctttacaagaatggaaatagcaaagaagctgcacaattgttctattcaatggccacgaagggcctgaaacctgacaccgtttcatatgctattctccttcatgggtatgccactgaaggatgcttggttgacatgatcaatctcttcaattcaatggcaacagactgtattctacctaactgtcatatcttcaacatactgatttatgcatatgctaaatctgggaagcttgataaggctatgcttatatttaaagatatgcagaaacaaggagtgagtccagatgcagtcacatattcaaccgtaatacatgcattttgcaaaaagggtaggttggatgatgctgtgataaagtttaatcagatgattgatacaggagtacgaccggaagcatctgcttatcgttccctaatccagggtttttgtacacatggcgatttggtgaaagcaaaggaatatgttactgaaatgatgaagaaaggtatgcttcctcctgatattatgttcttcagttcaatcatgcagaaactatgcacagaaggaagggtaatagaagcacgagatatccttgacttgatagtgcgcattggtatgaggcctaatgttttcatgtttaatatactgatcggtgggtactgcctagtctgcaagatggaggatgcaacaaaaatgtttgaggatatggtgtcatttggtttagaaccttgtaatattacgtatggtatacttattaatggctattgcaaaaatagaaggattgatgatgggcttattctgttccaagagatgctgcacaagggacttaaacctacaacttttaattataatgtcatactggatgggttatttctggctgga

SEQ ID NO: 2291 - DNA, 900 bp, Triticum aestivum
atgccccaactgggagttcaacctaatgtggtcatctacacctcaattatcgatgcactaagcaagtgcggagccatggacaaggcagaagtggtccttcagcaaatggttgatcaaggcattgaacccaacatcaggacatatactagcctgatacatggatattcagcttcgggtcagtggaaggcggcagctagagtattcaaggaaatggtaagtgttggtgttctaccaaatgctgtcactttgaactcatttatggattcactttgcaagcatagaaggacaaaggatgctagagatatttttgactccatggctgcaaagggccaaaaacctgacattttctcctactctattatgctaaatgggtatgctaaagaaggatacttcgaggatatgactgatctcttcaatttgatggtactgaatggtattgtacctaaccaccatattttcaacatactgatcaatgcatatgctaaacgtggactgatggatgaggctatgcacatgttcgaagtaatgaggcaacaaggagtaaacccaaatgtagttgactatgtagtagtaatggattcactttgcaaaatgggtaggatggatgctgctctggacaaatttactcagatggtcaatcaaggagtttcacctaacaaagctgtttaccaatgcctggttctgggttcttgctctcatggtcattttgtgaaagccaaggaattgatctctgaagcaattaatagaggtctgttttctaacagtgtgttcttctatcctgtaataaacgacctatgcaaagaaggaaaggtgaaggaggcacaggatatgtttgacttcattctaggtattggtcggcggcctgatgtgattatgtacaattcactgatggatggatat

SEQ ID NO: 2292 - DNA, 900 bp, Triticum aestivum; identical to SEQ ID NO: 2291

SEQ ID NO: 2293 - DNA, 585 bp, Triticum aestivum
atggctgcaaagggccaaaaacctgacattttctcctactctattatgctaaatgggtatgctaaagaaggatacttcgaggatatgactgatctcttcaatttgatggtactgaatggtattgtacctaaccaccatattttcaacatactgatcaatgcatatgctaaacgtggactgatggatgaggctatgcacatgttcgaagtaatgaggcaacaaggagtaaacccaaatgtagttgactatgtagtagtaatggattcactttgcaaaatgggtaggatggatgctgctctggacaaatttactcagatggtcaatcaaggagtttcacctaacaaagctgtttaccaatgcctggttctgggttcttgctctcatggtcattttgtgaaagccaaggaattgatctctgaagcaattaatagaggtctgttttctaacagtgtgttcttctatcctgtaataaacgacctatgcaaagaaggaaaggtgaaggaggcacaggatatgtttgacttcattctaggtattggtcggcggcctgatgtgattatatacaattcactgatggatggatat

SEQ ID NO: 2294 - DNA, 1296 bp, Triticum aestivum
atgacgacgctgctgccaagggtttccaccggtacacgacgaggcgagaggaagggtagcccccgatgccctctcagaaggccaggtggcacccacaggcgccaccgcgccggtgtcggccacagtccggatgtattcacctattcaactctagtatctgcactttgcagaatgggtaagctagctgatgctatggataagttcagtgagatgattggtacgggagtacaaccaggcacagttgtttatcactccctaattcagggtttctgtacacatggcgatttggtgaaagcaaaggagttggtatatgaaatgatgaacaaaggtagtccttgtccaaacattgcattcttcagttcaatagtagacagtctatgcaaagaaggaagggttatggatgcacaccatatctttgacttggttaaagacataggtgagagacctgacatcattatgtttaatacgctgattgacggatattgcctagtcggtgagatggagaaagcatgtggtgtatttgatgccatggtatcagctgtcgttgagcctgatgtcattacctatagtacacttgtcagtggatattgtaaaagtggaaggatcgatgatgggttgaatctgttcacagaaatgttgcataagaaagttaaacctacaactgttacatatggcaccatactggatgggttattttgtgctgggagatctgctgctgcaaagaaagtgttccatgagatgatcgaaagtggaataatggtgagcatttctacatataatataattcttggaggactttgtagaaataattgcgcagatgaagcgattgtcctattccagaaattgtgtgcaatgaatgtgaagttcaatatcacaacactcaataccatgcttaatgcattctacaaggttcaaagaagagaagaagctagtgatttgtttgctgcattaccagccagcgggttggtgcctaatgcttctacttacggagtaatgatacaaaatcttctaaaagaaggagcggtggaagaagctgacagtatgttctcatcaatggagaagagtggttgtgctcctagctctcgttttttaaattatatcatcagaacgttattggaaaaaggggagatagacaaggccggaaaatatatgtctaaagttgatgggaagactattttgcttgaagcttcaactacttcattgctgatgtccctcttttcaaggggaggcaaatatcaggagcacatactcttgctccctgcaaagtatcaactttttagtggagtgaaccacagt

SEQ ID NO: 2295 - DNA, 1296 bp, Triticum aestivum; identical to SEQ ID NO: 2294

SEQ ID NO: 2296 - DNA, 1296 bp, Triticum aestivum; identical to SEQ ID NO: 2294

SEQ ID NO: 2297 - DNA, 1296 bp, Triticum aestivum; identical to SEQ ID NO: 2294

SEQ ID NO: 2298 - DNA, 1248 bp, Triticum aestivum
atgcatatatatgctaaacgaggactgatagatgaagctgtgctcatacttactgaaatgcggggacacggactgagtccggatgtattcacctattcaactctagtatctgcactttgcagaatgggtaagctagctgatgctatggataagttcagtgagatgattggtacgggagtacaaccaggcacagttgtttatcactccctaattcagggtttctgtacacatggcgatttggtgaaagcaaaggagttggtatatgaaatgatgaacaaaggtagtccttgtccaaacattgcattcttcagttcaatagtagacagtctatgcaaagaaggaagggttatggatgcacaccatatctttgacttggttaaagacataggtgagagacctgacatcattatgtttaatacgctgattgacggatattgcctagtcggtgagatggagaaagcatgtggtgtatttgatgccatggtatcggctgtcgttgagcctgatgtcattacctatagtacacttgtcagtggatattgtaaaagtggaaggatcgatgatgggttgaatctgttcacagaaatgttgcataagaaagttaaacctacaactgttacatatggcaccataccggatgggttattttgtgctgggagatctgctgctgcaaagaaagtgttccatgagatgatcgaaagtggaataatggtgagcatttctacatataatataattcttggaggactttgtagaaataattgcgcagatgaagcgatcgtcctattccagaaatcgtgtgcaatgaatgtgaagttcaatatcacaacactcaataccatgcttaatgcattctacaaggttcaaagaagagaagaagctagtgatttgtttgctgcattaccagccagcgggttggtgcctaatgcttctacttacggagtaatgatacaaaatcttctaaaagaaggagcggtggaagaagctgacagtatgttctcatcaatggagaagagtggttgtgctcctagctctcgttttttaaattatatcatcagaacgttattggaaaaaggggagatagacaaggccggaaaatatatgtctaaagttgatgggaagactattttgcttgaagcttcaactacttcattgctgatgtccctcttttcaaggggaggcaaatatcaagagcacatactcttgctccctgcaaagtatcaactttttagtggagtgaaccacagt

SEQ ID NO: 2299 - DNA, 1296 bp, Triticum aestivum; identical to SEQ ID NO: 2294

SEQ ID NO: 2300 - DNA, 1296 bp, Triticum aestivum
atgacgacgctgctgccaagggtttccaccggtacacgacgaggcgagaggaagggtagcccccgatgccctctcagaaggccaggtggcacccacaggcgccaccgcgccggtgtcggccacagtccggatgtattcacctattcaactctagtatctgcactttgcagaatgggtaagctagctgatgctatggataagttcagtgagatgattggtacgggagtacaaccaggcacagttgtttatcactccctaattcagggtttctgtacacatggcgatttggtgaaagcaaaggagttggtatatgaaatgatgaacaaaggtagtccttgtccaaacattgcattcttcagttcaatagtagacagtctatgcaaagaaggaagggttatggatgcacaccatatctttgacttggttaaagacataggtgagagacctgacatcattatgtttaatacgctgattgacggatattgcctagtcggtgagatggagaaagcatgtggtgtatttgatgccatggtatcagctgtcgttgagcctgatgtcattacctatagtacacttgtcagtggatattgtaaaagtggaaggatcgatgatgggttgaatctgttcacagaaatgttgcataagaaagttaaacctacaactgttacatatggcaccatactggatgggttattttgtgctgggagatctgctgctgcaaagaaagtgttccatgagatgatcgaaagtggaataatggtgagcatttctacatataatataattcttggaggactttgtagaaataattgcgcagatgaagcgatcgtcctattccagaaattgtgtgcaatgaatgtgaagttcaatatcacaacactcaataccatgcttaatgcattctacaaggttcaaagaagagaagaagctagtgatttgtttgctgcattaccagccagcgggttggtgcctaatgcttctacttacggagtaatgatacaaaatcttctaaaagaaggagcggtggaagaagctgacagtatgttctcatcaatggagaagagtggttgtgctcctagctctcgttttttaaattatatcatcagaacgttattggaaaaaggggagatagacaaggccggaaaatatatgtctaaagttgatgggaagactattttgcttgaagcttcaactacttcattgctgatgtccctcttttcaaggggaggcaaatatcaggagcacatactcttgctccctgcaaagtatcaactttttagtggagtgaaccacagt

SEQ ID NO: 2301 - DNA, 675 bp, Triticum aestivum
atggtatcgtacggaatggatgaggctatgcacatgttcgaagtaatgaggcaacaaggagtaaacccagatgtatttggctatcaaatcataatggattcactttgtaaaatgggtaagatggatgctgctctggacaaatttaatcagatggtcaatcaaggagtttcacctaacaaagctgtttaccaatgcctggttctgggttcttgctctcatggtgattttgtgaaagccaaggaattgatttctgaagcggttaatagaggtatgtgttctaacagtgtgttcttctatcctgtaataaacgacctttgcaaagaaggaaaggtaaaggaggcacaggatatgtttgacttcatcctaggtattggtcagcggcctgatgtgattatgtacacttcactgatggatggatattgccttgttggcaaggtggagaaagcactgagtgtactcgatgctatgaaatttgctggccttcaacctgatgatgttgtatatggtacacttcttaacagttactgtaaaattggaaggattgccgatggattgagccttttcaggaaatgtcactcagcggggttaagcccacgactattatatacaacattatactggatgggctgttttgctctgggagaacaggttctgcaaaggaaaaattccatacga

SEQ ID NO: 2302 - DNA, 675 bp, Triticum aestivum; identical to SEQ ID NO: 2301

SEQ ID NO: 2303 - DNA, 1410 bp, Triticum aestivum
atggacttcaccgccacggacgtctttcagcactcgccctatggcgatatcctgaattcactaaagtctcyctctttgtcaggagagccctggccgaattgccaggccaagcgctcaaatgaggctttggacatgctgctccaccggacacctgaactacactgtgcgcctgatgtcttctcgtacaacatagtaatcaacggctgcttgaaagaaggtgaagtagacaaagcgtgcaatctcttccatgagatgccccaactgggagttcaacctgatgtggtgacctacacctcaatcatggacgcactaagcaagtccggagcaatggacaaggcagaagtgctccttcggcaaatggttgatcaaggaattgaacccaatatcaagacatatagctatctgatccatggatattctacttttggtcagtggaaggaggcacttagggtattcaaagaaatggcaagtcttggtgttgtaccagacgttgtcacgttgacctcattaatcgattccctttgcaagcacagaaggacaaaggaagctagagaaagttttgactctatggctgcaaagggcctgaaacctaatatcgtctcctactctactatgcttaatggttatgtcaaagaaggatcattcgaggatatgactgatctcttcaattcgatggtacggaatggtatcgtacctaaccaccatattttcaacatactgatcaatgcatatgctaaacgtggaggagtgawgkatgaggctatgcacatgttcgaagtaatgaggcaacaaggagtaaacccggatgtatttgactatcaaatcataatggattcactttgcaaaatgggtaggatggatgctgctctggacaaatttaatcagatggtcaatcaaggagtttcacctaacaaagctgtttaccaatgcctggttctgggttcttgctctcatggtcattttgtgaaagccaaggaattgatttctgaagtggttaatagaggtctgtgttctaacagtgtgttcttctatcctgtaataaacgrcctttgcaaagaaggaaaggtaaaggaggcacaggatatgtttgacttcatcctaggtattggtcagcggcctgatgtgattatgtacacttcactgatggatggatattgccttgttggcaaggtggagaaagcactgagtgtactcgatgctatgaaatttgctggccttcaacctgatgatgttgtatatggtacacttcttaacagttactgtaaaattggaaggattgccgatggattgagccttttcaggaaatgtcactcagcggggttaagcccacgactattatatacaacattatactggatgggctgttttgctctgggagaacaggttctgcaaaggaaaaattccatacga

SEQ ID NO: 2304 - DNA, 675 bp, Triticum aestivum; identical to SEQ ID NO: 2301

SEQ ID NO: 2305 - DNA, 1527 bp, Triticum aestivum
atgggcgaggcggagcttgagccccgaggcggcggcctcggtctgcgtggcgacggcggccgctgcggccgcctgggcggtgtggtggtcgggcctgggcgcggtgctgctgccgtgccgggtgctcgcggtggaggatggggttggctcttcttcggtctgctcggcggccggcggcgtcgtcccggtggccaggggagcaggtccggtgggtggctcctccggcagcgtctccaggcctggcgtggagcggatccggtggtcagggacctacctacacaccaaggccatgcctcgcttctcctccaccacgccaatggcgccaccccgcctccgcctccgactcggctcccgccactcctcctccacctctcatccctcacgcatctgggatccccacgccgccttcgccgccgccgcagaccgcgcgcgctctggcaacctcaccgcggaggacgcacaccacctgttcgacgaattgctgcggcagggcaatcctgtccaggaccgccccctcaacaaacttctctccgccctcgcccgtgctccggcgtccgcggcctgcggcgacggcccgccctcgcggtcgccctcttcagccgcatatcccaaggtgcccgccgacgggtggcagagccaacggcctgcacttacggtatcctcatggactgctgcagccgtgcgtgctgcccggaactggcgcttgccttcttcgcccgtctactgaggtcggggctgagggtaggtgtcatagaagtccgcaccctcctcaagggcctctgccatgcaaagcgggcagaggaggccatggacgtgctgcttcacaggatgcccgagctgggctgcaccccgggcgtggtggcatataacactgtcatcaacggcttctttaaggaaggccaagtaggcaaggcgtgcagtctattccatggaatgccgcagcggggcgttttgcctgatgtagtgacatatacctctgttgtcgatgggctgtgcaaggccagagccatggacaaggcagagtatttccttcgtcagatggttgatagtggtgtcgtacctgataatgtgacatataatagcctcatccatggatattcctctttgggccatcagaaggaggctgttagggtgctgaaagagatgaatcggagggttacaccagatgtcattacctgcacctcactcatggccttcctttgcaagaatggaaaaagcaaggaagctgcagaaatttttgattcaatggccacgaagggcctgaaacatgacgccgtttcatatgctattctccttcatgggtatgccactgaaggatgcttggttgatatgattaatctcttcaattcgatggacagagactgtattctacctgacggtcgtatcttcaacatactgattaatgcatatgctaaatctgggaaccttgataaggctatgcttatatttaaagaaatgcagaaacaaggagtgagtccagatgcagtcacatattcaaccgtaatacatgctttttgcaaaaaaggg

SEQ ID NO: 2306 - DNA, 864 bp, Triticum aestivum
atggactgctgcagccgtgcgtgctgcccggaactggcgcttgccttcttcgcccgtctactgaggtcggggctgagggtaggtgtcatagaagtccgcaccctcctcaagggcctctgccatgcaaagcgggcagaggaggccatggacgtgctgcttcacaggatgcccgagctgggctgcaccccgggcgtggtggcatataacactgtcatcaacggcttctttaaggaaggccaagtaggcaaggcgtgcagtctattccatggaatgccgcagcggggcgttttgcctgatgtagtgacatatacctctgttgtcgatgggctgtgcaaggccagagccatggacaaggcagagtatttccttcgtcagatggttgatagtggtgtcgtacctgataatgtgacatataatagcctcatccatggatattcctctttgggccatcagaaggaggctgttagggtgctgaaagagatgaatcggagggttacaccagatgtcattacctgcacctcactcatggccttcctttgcaagaatggaaaaagcaaggaagctgcagaaatttttgattcaatggccacgaagggcctgaaacatgacgccgtttcatatgctattctccttcatgggtatgccactgaaggatgcttggttgatatgattaatctcttcaattcgatggacagagactgtattctacctgacggtcgtatcttcaacatactgattaatgcatatgctaaatctgggaaccttgataaggctatgcttatatttaaagaaatgcagaaacaaggagtgagtccagatgcagtcacatattcaaccgtaatacatgctttttgcaaaaaaggg

SEQ ID NO: 2307 - DNA, 1527 bp, Triticum aestivum
atgggagaggcggagcttgagccccgaggcggcggcctcggtctgcgtggcgacggcggccgctgcggccgcctgggcggtgtggtggtcgggcctgggcgcggtgctgctgccgtgccgggtgctcgcggtggaggatggggttggctcttcttcggtctgctcggcggccggcggcgtcgtcccggtggccaggggagcaggtccggtgggtggctcctccggcagcgtctccaggcctggcgtggagcggatccggtggtcagggacctacctacacaccaaggccatgcctcgcttctcctccaccacgccaatggcgccaccccgcctccgcctccgactcggctcccgccactcctcctccacctctcatccctcacgcatctgggatccccacgccgccttcgccgccgccgcagaccgcgcgcgctctggcaacctcaccgcggaggacgcacaccacctgttcgacgaattgctgcggcagggcaatcctgtccaggaccgccccctcaacaaacttctctccgccctcgcccgtgctccggcgtccgcggcctgcggcgacggcccgccctcgcggtcgccctcttcagccgcatatcccaaggtgcccgccgacgggtggcagagccaacggcctgcacttacggtatcctcatggactgctgcagccgtgcgtgctgcccggaactggcgcttgccttcttcgcccgtctactgaggtcggggctgagggtaggtgtcatagaagtccgcaccctcctcaagggcctctgccatgcaaagcgggcagaggaggccatggacgtgctgcttcacaggatgcccgagctgggctgcaccccgggcgtggtggcatataacactgtcatcaacggcttctttaaggaaggccaagtaggcaaggcgtgcagtctattccatggaatgccgcagcggggcgttttgcctgatgtagtgacatatacctctgttgtcgatgggctgtgcaaggccagagccatggacaaggcagagtatttccttcgtcagatggttgatagtggtgtcgtacctgataatgtgacatataatagcctcatccatggatattcctctttgggccatcagaaggaggctgttagggtgctgaaagagatgaatcggagggttacaccagatgtcattacctgcacctcactcatggccttcctttgcaagaatggaaaaagcaaggaagctgcagaaatttttgattcaatggccacgaagggcctgaaacatgacgccgtttcatatgctattctccttcatgggtatgccactgaaggatgcttggttgatatgattaatctcttcaattcgatggacagagactgtattctacctgacggtcgtatcttcaacatactgattaatgcatatgctaaatctgggaaccttgataaggctatgcttatatttaaagaaatgcagaaacaaggagtgagtccagatgcagtcacatattcaaccgtaatacatgctttttgcaaaaaaggg

SEQ ID NO: 2308 - DNA, 1527 bp, Triticum aestivum
atgggcgaggcggagcttgagccccgaggcggcggcctcggtctgcgtggcgacggcggccgctgcggccrcctgggcggtgtggtggtcgggcctgggcgcggtgctgctgccgtgccgggtgctcgcggtggaggatggggttggctcttcttcggtctgctcggcggccggcggcgtcgtcccggtggccaggggagcaggtccggtgggtggctcctccggcagcgtctccaggcctggcgtggagcggatccggtggtcagggacctacctacacaccaaggccatgcctcgcttctcctccaccacgccaatggcgccaccccgcctccgcctccgactcggctcccgccactcctcctccacctctcatccctcacgcatctgggatccccacgccgccttcgccgccgccgcagaccgcgcgcgctctggcaacctcaccgcggaggacgcacaccacctgttcgacgaattgctgcggcagggcaatcctgtccaggaccgccccctcaacaaacttctctccgccctcgcccgtgctccggcgtccgcggcctgcggcgacggcccgccctcgcggtcgccctcttcagccgcatatcccaaggtgcccgccgacgggtggcagagccaacggcctgcacttacggtatcctcatggactgctgcagccgtgcgtgctgcccggaactggcgcttgccttcttcgcccgtctactgaggtcggggctgagggtaggtgtcatagaagtccgcaccctcctcaagggcctctgccatgcaaagcgggcagaggaggccatggacgtgctgcttcacaggatgcccgagctgggctgcaccccgggcgtggtggcatataacactgtcatcaacggcttctttaaggaaggccaagtaggcaaggcgtgcagtctattccatggaatgccgcagcggggcgttttgcctgatgtagtgacatatacctctgttgtcgatgggctgtgcaaggccagagccatggacaaggcagagtatttccttcgtcagatggttgatagtggtgtcgtacctgataatgtgacatataatagcctcatccatggatattcctctttgggccatcagaaggaggctgttagggtgctgaaagagatgaatcggagggttacaccagatgtcattacctgcacctcactcatggccttcctttgcaagaatggaaaaagcaaggaagctgcagaaatttttgattcaatggccacgaagggcctgaaacatgacgccgtttcatatgctattctccttcatgggtatgccactgaaggatgcttggttgatatgattaatctcttcaattcgatggacagagactgtattctacctgacggtcgtatcttcaacatactgattaatgcatatgctaaatctgggaaccttgataaggctatgcttatatttaaagaaatgcagaaacaaggagtgagtccagatgcagtcacatattcaaccgtaatacatgctttttgcaaaaaaggg

SEQ ID NO: 2309 - DNA, 1515 bp, Triticum aestivum
atgccacgcgtgcgacccggctcgtcctccagcaccgtctccgcacgcgccaaccagcagctgctaaacaaactcaaggatcatctggactctgggacgctccagccggagcgcgcacaccaactgttcgacaaattgctgcgccaaacggttccggtatcagcgtgcgcactcaatggcttatttgcttccctcgcgcgtgcgctgccctccgctgcctgcaccgacggctctgctctagccattgctctcttcaaccgcatggctcgagagggccgccgggtgatagcacccaacatttacacctacagcatactaattgactgctgctgccgctcgcgccgccctgacctaggtcccgccttcttcggcttcctcctcaagacaggcatcaaggcggacatcatcaccttcaccagcctattcaagtgcctctgtgacatgaagcggatagacgaggctgtgggagtgctgcttcacaggatgcccggagacatgcctgatgtcatctcctactcaacaatcctcaagggcttctgcaatgaggggaggagccagcttgcacttaatctgctccagatgatggtcaaaaaaggagctggccactcacccaacgtggtatcatacaacatggtaatcgatggcttctttaaggagggtgaagtaagcaaagcatgcaatctattccatgaaatgaaacagcggggggtcgtgcctgatgtgtggacatataattccattatcgatgcaatgtgcaaagcaagagcaatggacaaggcaaaattggtcctaagacaaatggttgatagtggggttcaaccggatattgtgacatataataaactgatccatggatattccatttcgggccagtttgaagaggtcgttaggttgttggacaaaatgagaagtcaaggcgtcaaaccaactgtttttacttgcaacacagtcatggactacctttgcaagcatggaagaatcaaagaagctgcagaatttttttattccatggttgagaagggccttaaacctaatatagtctcatatgctattatgtttcgtgggtacgctaaagaaggatcccttgttgaaatgactgatctctgtgagctgatggcaagagatggtattgtacccgatctccattgtttcaacatactgattaatgcatatgctaagtgtgggatgatggatgtggctatttttttcttcaaagacatgttgaagcagggagtgaaccctgatgaagtcacatatttagctgtgatagccgggtattgcagagtgggcatgatggatgatgctatggaaaatttcaatgagatgatcggtatgggagtaccacataacgcaactgtttacaggtgcatgattcagggttacttaaatcatggtgattttttgaaagcaaaggaattgattactgaaatgaagaccaagggtatccatcctagaccgcggaaaagccaagggtacctcatgacgcaactgtttacatcaatggaatgttggtca

SEQ ID NO: 2310 - DNA, 1515 bp, Triticum aestivum; identical to SEQ ID NO: 2309

SEQ ID NO: 2311 - DNA, 1512 bp, Triticum aestivum
atgccacgcgtgcgacccggctcgtcctccagcaccgtctccgcacgcgccaaccagctgctaaacaaactcaaggatcatctggactctgggacgctccagccggagcgcgcacaccaactgttcgacaaattgctgcgccaaaccgttccggtaccagcgtccgcactcaatggcttatttgccgccctcgcgcgtgcgctgccctccgctgcctgcaccgacggccctgctctagccattgctctctttaaccgcatggctcgagagggccgccgggtgatagcacccaacatttacacctacagcatactaattgactgctgctgccgctcgcgccgccctgacctaggtcccgccttcttcggcttcctcctcaagacaggcatcaaggcggacatcatcaccttcaccagcctattcaagtgcctctgtgacatgaagcggatagacgaggctgtgggagtgctgcttcacaggttgcccggagacatgcctgatgtcatctcctactcaacaatcctcaagggcttctgcaatgaggggaggagccagcttgcacttaatctgctccagatgatggtcaaaaaaggagctggccactcacccaacgtggtatcatacaacatggtaatcgatggcttctttaaggagggtgaagtaagcaaagcatgcaatctattccatgaaatgaaacagcggggggtcgtgcctgatgtgtggacatataattccattattgatgcaatgtgcaaagcaagagcaatggacaaggcaaaattggtcctaagacaaatggttgatagtggggttcaaccggatattgtgacatataataaactgatccatggatattccatttcgggccagtttgaagaggtcgttaggttgttggacaaaatgagaagtcaaggcgtcaaaccaactgtttttacttgcaacacagtcatggactacctttgcaagcatggaagaatcaaagaagctgcagaatttttttattccatggttgagaagggccataaacctaatatagtctcatatgctattatgtttcgtgggtacgctaaagaaggatcccttgttgaaatgactgatctctgtgagctgatggcaagagatggtattgtacccgatctccattgtttcaacatactgattaatgcatatgctaagtgtgggatgatggatgtggctattcttttcttcaaagacatgttgaagcagggagtgaaccctgatgaagtcacatatttagctgtgatagccgggtattgcagagtgggcatgatggatgatgctatggaaaatttcaatgagatgatcggtatgggagtaccacataacgcaactgtttacaggtgcatgattcagggttacttaaatcatggtgatttcttgaaagcaaaggaattgattactgaaatgaagaccaagggtatccatcctagaccgcggaaaagccaaggaattgatccagggtacctcatgacgcaactgtttacaggtgca

SEQ ID NO: 2312 - DNA, 1515 bp, Triticum aestivum; identical to SEQ ID NO: 2309

SEQ ID NO: 2313 - DNA, 1515 bp, Triticum aestivum; identical to SEQ ID NO: 2309

SEQ ID NO: 2314 - DNA, 1512 bp, Triticum aestivum; identical to SEQ ID NO: 2311

SEQ ID NO: 2315 - DNA, 1425 bp, Triticum aestivum
atgatgcagcaagggattgtgcctaatgtggtgacatatagctcgattattgatgccttgtgcaaggtcagggcaatggacaaggcaaagctggtccttcagcagatggttgataatggtgttcaaccagatgttgttacttggaactcattcatgtactccttttgcaagcatggaaaaagcaaagaagctgcagaattttttgactccatgaccaccaagggcctcaaacctgatattgtcgcgtactctactcttcttcacgggtatgctactgaaggatgcctagccgatatgattaatctctttaatacaatggaagacaatggtattgtagccaactgcaatgttttcaacatattaattgatgcatatgctaaacgtggaatgatgcatgaagctatgctcatatttaccgaaatgcaggaacaaagagttagtctggatgtgtgcacctatgcaactgtaatagctgcactttgcagaatgggcaggctggctgatgccatggacaaactaaatgagatgattgctatgggattacaaccgaacaaggttgtttatcactctctaattcagggcttttgtacacatagtgatttggtgaaagcaaaggccttggtttctgaaatgatgaacaaaggtattcctcgtccaaacattgtgttcttcagctcagtaataaacagcctatgcaaggaaggaagggttacagatgcacacgatatcttcgacttggctataaacattggtgagaggcctgacgttattacatttaattcactgattgacggatattgtttagccgggaagatggataaagcattcggagtacttgatgccatggtatcagctggcattgagcacaatgttgtcacatacaatacacttgttgatggctattctagaaatggaaggattgatgatgggttgaccctattcagagaaatgacgcgtaacaaaattaaacctacaactgctacatatggcgccatacttcatgggttgtttcgtgctggcagaacttcttctgcgaagaaaatgttcaatgagatgattgaaagtggaacaacagtggacattcccatatatgctataattcttggaggactttgtagaaacaattgcgttgatgaagcaatcatcttgttcgagaaattaggtgcaatgaatgtgaagttggatgttggaatattcaataccatgattaatgcagtgtacacggttaagggaagagaagaagctaaggatttgtttgctgcaatatcagccaattggttggtacctaatgcttcttcttacggtgttatgataacaaatcttctaagagaaggattagtggaagaagctgacaatatgttttcatcaatggacaagagtggttgtgctcctagctctcgtctgttaaatattatcatcagaatg

SEQ ID NO: 2316 - DNA, 1425 bp, Triticum aestivum; identical to SEQ ID NO: 2315

SEQ ID NO: 2317 - DNA, 1425 bp, Triticum aestivum; identical to SEQ ID NO: 2315

SEQ ID NO: 2318 - DNA, 1425 bp, Triticum aestivum; identical to SEQ ID NO: 2315

SEQ ID NO: 2319 - DNA, 1425 bp, Triticum aestivum; identical to SEQ ID NO: 2315

SEQ ID NO: 2320 - DNA, 1425 bp, Triticum aestivum; identical to SEQ ID NO: 2315

SEQ ID NO: 2321 - DNA, 1503 bp, Triticum aestivum
atgctccgccgcatccgcctccgtcgccgcccctacccctcctgcacctacccggagcccgtcctctgccactcctccagctttatctctgcggctcccctcctccgcctccaccagtaccgcaccaccaccacgccgatgtcccgcatccacctccgccgtcgcctcttctcctccaccacgcggccctcgcactcctggtctccacatgccgcctttgccgcagcaacagagcgcgtacgcaccggggcgctcagccaagacgatgcacaccacctgttcgacgaattgctgcggcaggccaccccggtccccgggcgctccctcaacggcttccttgccgccctcgcccgtgcgcccgcctccggagcctgcagagatgggcccgccctcgccctcgctctcttcaaccgcgtctgcctggatgaatccggcgcgcgggtggcaccgcccacaatcttcacctacggcatcctcatgaactgctgctgccgcgcgcatcgcccggacctagggctcgccttcttggctcgcctcctcaggacgggcctgaaggctgaccagatcgtcgccaacaccttcctcaagtgcctctgctgcgcgaaacggacggatgaggctgtgaacgtgctgcttcataggatgccccggctcggctgtgtgcctaatgccttctcatacagcattgttctcaagagcttatgcgataatggcatgagccggcaggcgctcgacctgctccatatgatggcgaaagaaggaggtggctgctcccccaacgtggtggcgtatagcacagtcatccatggcttctttaaggaaggtgaaacaggcaaggcatgcaatctgttccatgaaatgatgcagcaaggtgttgagcccaatgtgtggacatatagttcaatcattgatgcgttgtgcaaggccagagcaatggacaaggcagagctagtgcttgagaagatggttaacaaaggtgttcaacccaataatgtgacatataattgcatgatccatggatattccacatcagggcagttgaaagaggctgctaaaatgttcagagaaatgacaagtcagggtcttataccagataactttacttgcagctccttaatgacttacctttgtaagcatggaagaagcaaagaagctgcagaattttttgatgccatgactgccaaaggccacagagatgtcatctcctactgcattttgcttcatgggtatgccaatgaaggatgctttgctgatatgattgatctctttaattcaatgcaaagaaacggtattgctgccaactgccatgttttcaacatattaattaatggatatgctaaacgtggaatgacggatgaagctatgctgatatttacagaaatgtgggaaaaaggagtgagtcccgatgtagtcacctattccactgtaatagctgcactttccaggatgggggggttgaccgacgctatggaaaaatttaatcagatgattgccatgggaatt

SEQ ID NO: 2322 - DNA, 1470 bp, Triticum aestivum
atgtggtggcgtatagcacggtcatccatggcttttttaaggagggtgaaacagggaaggcatgcagtctattccatgacagccaagggccaaaaacctgatatcatctcgtattgtactttgcttcatgggyatgccartgaaggatgctttrctgatatgattgatctctttaattcaatgaaaagcaacggtattgcagctgactgccgtgtttttaccatattaattgatgcctatgctaaacgtggaatgatggatgatgcaatgcacatatttacggaaatgtgggaaaaaggagtgagtcccgatgtggttacctattccactgtaatagctgcactttccaggatgggtagattgaccgatgctatggacaaatttaatcagatgatttccatgggggttcaaccgaacacagttgtttatcacaccctaattcagggctcttgtatgcatggtgatttgattaaagccaaggagctggtttctgaaatgatgaacaaaggtattcctcgtcctagcattgcgttcttcggttcaataataaacaggttatgcaaagatggaagggttatggatgcacatgatatctttgacttggttatagacataggcgagaggcctagtgtcattacatttaattcactggttgacggatattgcttagtcggcaagatggataaagcatttggaatgcttaatgccatggaatcagttggtgttgagcctgatattgttacttacagtacacttcttgatggctattttaaaaatggaaggatcaatgatggtttgactctgtttagagaaatgccgcttaagagaattaaacctgacactgttacatatggcatcatgttggatgggtgttttcgtgctgggagaactgttgctgcaaggacaatgttccatgagatgatcgaaagtggaataacagtggacatccccacatataatatagttcttaggggactttgtagaaataactgcacagatgaagcaatcgccctgttccagaaattaggtgcaatgagtatgaagttcaatattgcaatactcaataccatgatcaatgcaatctacaaggttcggagaagagaagaagctaacaatttgtttgctgcaatatcagccagtgggttggtgcccaatcaatctacttatgctgtaatgataataaatcttctaaaagatggagcagtggaacatgctagcaatatgttttcatcaatggagaaaagtggtattgtccccagctcccgtcttataaatggtatcatcagattgttgttggagaatggtgagattgccaaggctggaatttatttgtctaaagttgatgggaatagcatctcacttgaagcttcaactacttcattgatgttgtctctgttttcaaggaaagggaaatatcaggaggacatgaagttgctccctgcaaagtatcaattttttggtgaatttggc

SEQ ID NO: 2323 - DNA, 1509 bp, Triticum aestivum
atgccacgcgtccgacccggctcgtcctccagcaccgtctcctcacgcgccaaccagctgctaaacaaactcaaggatcatctgggctctgggacgctccagccggagcgcgcacaccaactgttcgacaaattgctgcgccaaaccgttccggtatcagcgttcgcactcaatggcttatttgccgccctcgcgcgtgcgctgccctccgctgcctgcaccgacggccctgctctagccattgctctcttcaaccgcatggctcgagagggccgccgggtgatagagcccaacatttacacctacaacatactaattgactgctgctgccgctcgcgccaccctgacctaggtcccgccttcttcggcttcctcctcaagacaggcatcaaggcggacatcatcaccttcaacagcctattgaagtgcctctgtgacatgatgcagatggaggaggccctcaacatgctgctctacaggatgcctgagctgcctgatagcatctcctactcaataattattaagagcttatgtgacaatgggaggagccaatgtgcacttgacctgctccggatgaaggccaaaaagggagctgaccactaccctggattggtggcatacaacagggtaatcaatggcttaattaaggagggtgaactaagcaaagcatgctctctattccatgaaatgatgcagcagggggtcgtgcctaatgtggtgacgtatagctccattatcgatgcattgtgcaaagcaggagcaatggacaaggcagaggtggcccttcgacaaatggttggtaatggtgttcgaccggatatttttacatatactagcctgatccatggatattccatttcaggccagtttgaagaggtcgttaggttgttggaaaaattgagaagtcaaggtgtcaaaccaactgtttttacctgcaacacagtcatggactacctttgcaagcatggaaaaatcaaagaagctgcagaatttttttattccatgcctgagaagggccataaacctaatatagtgtcatactctattatgctttatgggtacgctaaagaaggatcccttgttgaaatgactgatctctgtgagctgatggcaagagacggtattgtacccgatctccattgtttaaacatactgattaatgcatatgctaagtgtggaatgatggatgtagctatgcttttcttcaaagacatgttgaagcagggagtgaaccctgatgaagtcacatatttagctgtgataaccgggtattgcagagtgggcatgatggatgatgctatggaaaaattcaatgagatgatcgatatgggagtaccacgtaactcaactgtttacaggtgcatgattcagggttacttaaatcatggtgatttcttgaaagcaaaggtattgactactgaaatgaagaccaagggtatccatcctagaccacggaaaagccaaagaattgattcagggtacctcatgacacaactatttacaggtgca

SEQ ID NO: 2324 - DNA, 1509 bp, Triticum aestivum
atgccacgcgtccgacccggctcgtcctccagcaccgtctcctcacgcgccaaccagctgctaaacaaactcaaggatcatctgggctctgggacgctccagccggagcgcgcacaccaactgttcgacaaattgctgcgccaaaccgttccggtatcagcgttcgcactcaatggcttatttgccgccctcgcgcgtgcgctgccctccgctgcctgcaccgacggccctgctctagccattgctctcttcaaccgcatggctcgagagggccgccgggtgatagagcccaacatttacacctacaacatactaattgactgctgctgccgctcgcgccaccctgacctaggtcccgccttcttcggcttcctcctcaagacaggcatcaaggcggacatcatcaccttcaacagcctattgaagtgcctctgtgacatgatgcagatggaggaggccctcaacatgctgctctacaggatgcctgagctgcctgatagcatctcctactcaataattattaagagcttatgtgacaatgggaggagccaatgtgcacttgacctgctccggatgaaggccaaaaagggagctgaccactaccctggattggtggcatacaacagggtaatcaatggcttaattaaggagggtgaactaagcaaagcatgctctctattccatgaaatgatgcagcagggggtcgtgcctaatgtggtgacgtatagctccattatcgatgcattgtgcaaagcaggagcaatggacaaggcagaggtggcccttcgacaaatggttggtaatggtgttcgaccggatatttttacatatactagcctgatccatggatattccatttcaggccagtttgaagaggtcgttaggttgttggaaaaattgagaagtcaaggtgtcaaaccaactgtttttacttgcaacacagtcatggactacctttgcaagcatggaaaaatcaaagaagctgcagaatttttttattccatgcctgagaagggccataaacctaatatagtgtcatactctattatgctttatgggtacgctaaagaaggatcccttgttgaaatgactgatctctgtgagctgatggcaagagacggtattgtacccgatctccattgtttaaacatactgattaatgcatatgctaagtgtggaatgatggatgtagctatgcttttcttcaaagacatgttgaagcagggagtgaaccctgatgaagtcacatatttagctgtgataaccgggtattgcagagtgggcatgatggatgatgctatggaaaaattcaatgagatgatcgatatgggagtaccacataactcaactgtttacaggtgcatgattcagggttacttaaatcatggtgatttcttgaaagcaaaggtattgactactgaaatgaagaccaagggtatccatcctagaccacggaaaagccaaagaattgattcagggtacctcatgacacaactatttacaggtgca

SEQ ID NO: 2325 - DNA, 1509 bp, Triticum aestivum; identical to SEQ ID NO: 2324

SEQ ID NO: 2326 - DNA, 1509 bp, Triticum aestivum; identical to SEQ ID NO: 2324

SEQ ID NO: 2327 - DNA, 1509 bp, Triticum aestivum; identical to SEQ ID NO: 2324

SEQ ID NO: 2328 - DNA, 1509 bp, Triticum aestivum; identical to SEQ ID NO: 2323

SEQ ID NO: 2329 - DNA, 909 bp, Triticum aestivum
atggactgctgctgccgcgcgcgtcgcccggacctagggctcgccttattcggccgcttcctcgggacaggcctgaggacaaacgagatcgtcgccaccaccttcctcaagtgcctctgctgcgcgaaacggacagaagaggttgtgaaagtactgcttcacagaatgcccgagctgggctgtgtgcctaatgccatctcgtactccatagttttgaaaagcttgtgtgaaaatagcatgagtcagcaggcactcgacctgctccagatggtagggaaagaaggaggctgccttcgtgatgtggtggcatataacacaatcatccatggcttctttaaggagggcggaatagacaaggcatgccatctattccatgaaatgatgcggcaaggggttgtgccgactgtggtgacatacaacacagtaattgatgcgttgtgcaaggccggagaaatggacaaggcagagctagtctttcagcagatggctcgtaatggtgcgcagcccaataaagtgacatgtaatggcagtaaatttagttcactgactgacggatattgctcagtcggcaagatggataaaacattcaaactgcttgatgccatggtatcagttggaattgagcctgatgctgttacttatagtgcacttcttgatggctattttaaaaatggaaggatcgatgatggtttgactctatttagagaaatgtcgtgcaagggagttaaaccaacaactgtgacatatggcatcatactggatggtttatatcgtgctgggagaactgctgctgccaagaaaatgtttgatcagatgatcaaaagtggaataacagtgaccgtttccatatacactactccctcctttccggtttataaggcgtatttcaacttttttgtttttccaatt

SEQ ID NO: 2330 - DNA, 909 bp, Triticum aestivum; identical to SEQ ID NO: 2329

SEQ ID NO: 2331 - DNA, 909 bp, Triticum aestivum
atggactgctgctgccgcgcgcgtcgcccggacctagggctcgccttattcggccgcttcctcgggacaggcctgaggacaaacgagatcgtcgccaccaccttcctcaagtgcctctgctgcgcgaaacggacagaagaggttgtgaaagtactgcttcacagaatgcccgagctgggctgtgtgcctaatgccatctcgtactccatagttttgaaaagcttgtgtgaaaatagcatgagtcagcaggcactcgacctgctccagatggtagggaaagaaggaggctgccttcgtgatgtggtggcatataacacaatcatccatggcttctttaaggagggcggaatagacaaggcatgccatctattccatgaaatgatgcggcaaggggttgtgccgactgtggtgacatacaacacagtaattgatgcgttgtgcaaggccggagaaatggacaaggcagagctagtctttcagcggatggctcgtaatggtgcgcagcccaataaagtgacatgtaatggcagtaaatttagttcactgactgacggatattgctcagtcggcaagatggataaaacattcaaactgcttgatgccatggtatcagttggaattgagcctgatgctgttacttatagtgcacttcttgatggctattttaaaaatggaaggatcgatgatggtttgactctatttagagaaatgtcgtgcaagggagttaaaccaacaactgtgacatatggcatcatactggatggtttatatcgtgctgggagaactgctgctgccaagaaaatgtttgatcagatgatcaaaagtggaataacagtgaccgtttccatatacactactccctcctttccggtttataaggcgtatttcaacttttttgtttttccaatt

SEQ ID NO: 2332 - DNA, 909 bp, Triticum aestivum; identical to SEQ ID NO: 2329

SEQ ID NO: 2333 - DNA, 1512 bp, Triticum aestivum
atgccaaatgcaaatggtgtgaagatgtttgttatttcacggtacacagttgtgctcacttttcttgtcaatttcagccacctactcaaggccatctgtgcggagaagaagaccagctatgcaatggacatcgtactccgagtaatgcccgagtttaactatgttccgaacattttctcctataacattcttttcaagggtctctgcaacgagaagagaagccaagaggctctcgagctgattcaaattatggttgaggatggaggtggctgccgacctgatgtggtgacctatagcactgtaattgatggcttgttgaaagagggtgaggtggaccaagcttacagcctattttctgaaatgctgcgtcagggggtatcaccgaatattgtgacctgtaattcaatcatctctggcatgtgcaagcttcacgcgatggacaaggctgaggaggttcttcaacagatgcttgatagacgaattctgccagatgttaccacatatactagtctaatacatggatattattcattaggacagtgcgaggaggtggatcgggttttcaaagaaatgtctagaaatggtgttcaaccaaatattataacttatagtatacagatggattatctttgcaagaatggaagatgcacagaagctaggaagatttttgattctatggtcagtttgggccaaaaaccagatgttactacctacagcattctgcttcatgggtatgctatggaacgatcttttcatgatattcattgtctcattgatttgatggtcgaaaatggtctgtcaccaaataactatatctacaacatactcatatctgcatgtgctaaagaaaaaatggttgatgaggcgatgcatatatttacaaaaatgcggcagcaaggattgaaccctgatgcagtgagctacggaacagtaatagacttgctttccagttttggccgaatggatgatgctatgtccctattcaataaaatgataactgaaggattagctcctggtatcatagttttcaaccaccttattagtggtttttgtacttgtggcaaatgggtgaaggttcatgaactattttctgagatgttggatcgcggcatctgtcccaacacagtgttcttcaacacaattatggatcgcctttgcaaaaatggaagggttatggatgcccaagatctcttcgacctaatgatacacatgggtgtgaagcctgatgtgtgtacttatagcacactgataggtggatacttgttcgttggtaagatggatgaagtgaggaagttactagaaaatatgtgctcaattggcttgaaaccagatgttgtcacctatagcatactgatagatggttactctaagaatggaaggatagatgatgcactggttgttatcagggaaatggacggtgttaagccttctattatcacttttaatattatgattggtgtgttgcttaaaggtagcagaatggaagaagccaaagatttgtttgacggtatc

SEQ ID NO: 2334 - DNA, 1512 bp, Triticum aestivum
  misc_feature (611)..(611): n is a, c, g, or t
  misc_feature (1070)..(1070): n is a, c, g, or t
atgccaaatgcaaatggtgtgaagatgtttgttatttcacggtacacagttgtgctcacttttcttgtcaatttcagccacctactcaaggccatctgtgcggagaagaagaccagctatgcaatggacatcgtactccgagtaatgcccgagtttaactgtgttccgaacattttctcctataacattcttttcaagggtctctgcaacgagaagagaagccaagaggctctcgagctgattcaaattatggttgaggatggaggtggctgccgacctgatgtggtgacctatagcactgtaattgatggcttgttgaaagagggtgaggtggaccaagcttacagcctattttctgaaatgctgcgtcagggggtatcaccgaatattgtgacctgtaattcaatcatctctggcatgtgcaagcttcacgcgatggacaaggctgaggaggttcttcaacagatgcttgatagacgaattctgccagatgttaccacatatactagtctaatacatggatattattcattaggacagtgcgaggaggtggatcgggttttcaaagaaatgtctagaaatggtgttcaaccaaatattataacttatantatacagatggattatctttgcaagaatggaagatgcacagaagctaggaagatttttgattctatggtcagtttgggccaaaaaccagatgttactacctacagcattctgcttcatgggtatgctatggaacgatcttttcatgatattcattgtctcattgatttgatggtcgaaaatggtctgtcaccaaataactatatctacaacatactcatatctgcatgtgctaaagaaaaaatggttgatgaggcgatgcatatatttacaaaaatgcggcagcaaggattgaaccctgatgcagtgagctacggaacagtaatagacttgctttccagttttggccgaatggatgatgctatgtccctattcaataaaatgataactgaaggattagctcctggtatcatagttttcaaccaccttattagtggtttttgtacttgtggcaaatgggngaaggttcatgaactattttctgagatgttggatcgcggcatctgtcccaacacagtgttcttcaacacaattatggatcgcctttgcaaaaatggaagggttatggatgcccaagatctcttcgacctaatgatacacatgggtgtgaagcctgatgtgtgtacttatagcacactgataggtggatacttgttcgttggtaagatggatgaagtgaggaagttactagaaaatatgtgctcaattggcttgaaaccagatgttgtcacctatagcatactgatagatggttactctaagaatggaaggatagatgatgcactggttgttatcagggaaatggacggtgttaagccttctattatcacttttaatattatgattggtgtgttgcttaaaggtagcagaatggaagaagccaaagatttgtttgacggtatc

SEQ ID NO: 2335 - DNA, 1512 bp, Triticum aestivum
atgccaaatgcaaatggtgtgaagatgtttgttatttcacggtacacagttgtgctcacttttcttgtcaatttcagccacctactcaaggccatctgtgcggagaagaagaccagctatgcaatggacatcgtactccgagtaatgcccgagtttaactgtgttccgaacattttctcctataacattcttttcaagggtctctgcaacgagaagagaagccaagaggctctcgagctgattcaaattatggttgaggatggaggtggctgccgacctgatgtggtgacctatagcactgtaattgatggcttgttgaaagagggtgaggtggaccaagcttacagcctattttctgaaatgctgcgtcagggggtatcaccgaatattgtgacctgtaattcaatcatctctggcatgtgcaagcttcacgcgatggacaaggctgaggaggttcttcaacagatgcttgatagacgaattctgccagatgttaccacatatactagtctaatacatggatattattcattaggacagtgcgaggaggtggatcgggttttcaaagaaatgtctagaaatggtgttcaaccaaatattataacttatattatacagatggattatctttgcaagaatggaagatgcacagaagctaggaagatttttgattctatggtcagtttgggccaaaaaccagatgttactacctacagcattctgcttcatgggtatgctatggaacgatcttttcatgatattcattgtctcattgatttgatggtcgaaaatggtctgtcaccaaataactatatctacaacatactcatatctgcatgtgctaaagaaaaaatggttgatgaggcgatgcatatatttacaaaaatgcggcagcaaggattgaaccctgatgcagtgagctacggaacagtaatagacttgctttccagttttggccgaatggatgatgctatgtccctattcaataaaatgataactgaaggattagctcctggtatcatagttttcaaccaccttattagtggtttttgtacttgtggcaaatgggagaaggttcatgaactattttctgagatgttggatcgcggcatctgtcccaacacagtgttcttcaacacaattatggatcgcctttgcaaaaatggaagggttatggatgcccaagatctcttcgacctaatgatacacatgggtgtgaagcctgatgtgtgtacttatagcacactgataggtggatacttgttcgttggtaagatggatgaagtgaggaagttactagaaaatatgtgctcaattggcttgaaaccagatgttgtcacctatagcatactgatagatggttactctaagaatggaaggatagatgatgcactggttgttatcagggaaatggacggtgttaagccttctattatcacttttaatattatgattggtgtgttgcttaaaggtagcagaatggaagaagccaaagatttgtttgacggtatc

SEQ ID NO: 2336 - DNA, 1077 bp, Triticum aestivum
atggacaaggctgaggaggatcttcaacagatgcatgatagacgaattctgccagatgttaccacatatactagtctaatacatggatattattcattaggacagtgcgaggaggtggatcgggttttcaaagaaatgtctagaaatggtgttcaaccaaatattataacttatagtatacagatggattatctttgcaagaatggaagatgcacagaagctaggaagatttttgattctatggtcagtttgggccaaaaaccagatgttactacctacagcattctgcttcatgggtatgctatggaacgatcttttcatgatattcattgtctcattgatttgatggtcgaaaatggtctgtcaccaaataactatatctacaacatactcatatctgcatgtgctaaagaaaaaatggttgatgaggcgatgcatatatttacaaaaatgcggcagcaaggattgaaccctgatgcagtgagctacggaacagtaatagacttgctttccagttttggccgaatggatgatgctatgtccctattcaataaaatgataactgaaggattagctcctggtatcatagttttcaaccaccttattagtggtttttgtacttgtggcaaatgggtgaaggttcatgaactattttctgagatgttggatcgcggcatctgtcccaacacagtgttcttcaacacaattatggatcgcctttgcaaaaatggaagggttatggatgcccaagatctcttcgacctaatgatacacatgggtgtgaagcctgatgtgtgtacttatagcacactgataggtggatacttgttcgttggtaagatggatgaagtgaggaagttactagaaaatatgtgctcaattggcttgaaaccagatgttgtcacctatagcatactgatagatggttactctaagaatggaaggatagatgatgcactggttgttatcagggaaatggacggtgttaagccttctattatcacttttaatattatgattggtgtgttgcttaaaggtagcagaatggaagaagccaaagatttgtttgacggtatc

SEQ ID NO: 2337 - DNA, 1512 bp, Triticum aestivum
atgccaaatgcaaatggtgtgaagatgtttgttatttcacggtacacagttgtgctcacttttcttgtcaatttcagccacctactcaaggccatctgtgcggagaagaagaccagctatgcaatggacatcgtactccgagtaatgcccgagtttaactgtgttccgaacattttctcctataacattcttttcaagggtctctgcaacgagaagagaagccaagaggctctcgagctgattcaaattatggttgaggatggaggtggctgccgacctgatgtggtgacctatagcactgtaattgatggcttgttgaaagagggtgaggtggaccaagcttacagcctattttctgaaatgctgcgtcagggggtatcaccgaatattgtgacctgtaattcaatcatctctggcatgtgcaagcttcacgcgatggacaaggctgaggaggttcttcaacagatgcttgatagacgaattctgccagatgttaccacatatactagtctaatacatggatattattcattaggacagtgcgaggaggtggatcgggttttcaaagaaatgtctagaaatggtgttcaaccaaatattataacttataktatacagatggattatctttgcaagaatggaagatgcacagaagctaggaagatttttgattctatggtcagtttgggccaaaaaccagatgttactacctacagcattctgcttcatgggtatgctatggaacgatcttttcatgatattcattgtctcattgatttgatggtcgaaaatggtctgtcaccaaataactatatctacaacatactcatatctgcatgtgctaaagaaaaaatggttgatgaggcgatgcatatatttacaaaaatgcggcagcaaggattgaaccctgatgcagtgagctacggaacagtaatagacttgctttccagttttggccgaatggatgatgctatgtccctattcaataaaatgataactgaaggattagctcctggtatcatagttttcaaccaccttattagtggtttttgtacttgtggcaaatgggagaaggttcatgaactattttctgagatgttggatcgcggcatctgtcccaacacagtgttcttcaacacaattatggatcgcctttgcaaaaatggaagggttatggatgcccaagatctcttcgacctaatgatacacatgggtgtgaagcctgatgtgtgtacttatagcacactgataggtggatacttgttcgttggtaagatggatgaagtgaggaagttactagaaaatatgtgctcaattggcttgaaaccagatgttgtcacctatagcatactgatagatggttactctaagaatggaaggatagatgatgcactggttgttatcagggaaatggacggtgttaagccttctattatcacttttaatattatgattggtgtgttgcttaaaggtagcagaatggaagaagccaaagatttgtttgacggtatc

SEQ ID NO: 2338 - DNA, 1512 bp, Triticum aestivum
atgccaaatgcaaatggtgtgaagatgtttgttatttcacggtacacagttgtgctcacttttcttgtcaatttcagccacctactcaaggccatctgtgcggagaagaagaccagctatgcaatggacatcgtactccgagtaatgcccgagtttaactgtgttccgaacattttctcctataacattcttttcaagggtctctgcaacgagaagagaagccaagaggctctcgagctgattcaaattatggttgaggatggaggtggctgccgacctgatgtggtgacctatagcactgtaattgatggcttgttgaaagagggtgaggtggaccaagcttacagcctattttctgaaatgctgcgtcagggggtatcaccgaatattgtgacctgtaattcaatcatctctggcatgtgcaagcttcacgcgatggacaaggctgaggaggttcttcaacagatgcttgatagacgaattctgccagatgttaccacatatactagtctaatacatggatattattcattaggacagtgcgaggaggtggatcgggttttcaaagaaatgtctagaaatggtgttcaaccaaatattataacttatagtatacagatggattatctttgcaagaatggaagatgcacagaagctaggaagatttttgattctatggtcagtttgggccaaaaaccagatgttactacctacagcattctgcttcatgggtatgctatggaacgatcttttcatgatattcattgtctcattgatttgatggtcgaaaatggtctgtcaccaaataactatatctacaacatactcatatctgcatgtgctaaagaaaaaatggttgatgaggcgatgcatatatttacaaaaatgcggcagcaaggattgaaccctgatgcagtgagctacggaacagtaatagacttgctttccagttttggccgaatggatgatgctatgtccctattcaataaaatgataactgaaggattagctcctggtatcatagttttcaaccaccttattagtggtttttgtacttgtggcaaatgggtgaaggttcatgaactattttctgagatgttggatcgcggcatctgtcccaacacagtgttcttcaacacaattatggatcgcctttgcaaaaatggaagggttatggatgcccaagatctcttcgacctaatgatacacatgggtgtgaagcctgatgtgtgtacttatagcacactgataggtggatacttgttcgttggtaagatggatgaagtgaggaagttactagaaaatatgtgctcaattggcttgaaaccagatgttgtcacctatagcatactgatagatggttactctaagaatggaaggatagatgatgcactggttgttatcagggaaatggacggtgttaagccttctattatcacttttaatattatgattggtgtgttgcttaaaggtagcagaatggaagaagccaaagatttgtttgacggtatc

SEQ ID NO: 2339 - DNA, 1209 bp, Triticum aestivum
atgtcacactctttctccagctccgtttcctcatgcgccaacgagctgctgaacgaactccacgaccatctgggcttcaggacgctcaggccagagctcgcgcaccaactgttcgatgaaatgctacgccaaccagtcccagtatcagtacgtgcactcaacgacttatttgttgcccttgcgcgtgcgccgccctccaccatctgcaccgacggacctgccctcgccattgatctcttcaaccgcatggcccaagcaggccgtcgccaggtgatagcacccaccattatcacctacaacatactaattgactgctgccaccgagcatgccgcccggacctagggcatgccttcttcggtcgcctcctcaagacaggcatcacaatgagcgtcattacctacaacagcctattcatgtgcctctgtgacatgaggcgaacaaaggaggctctgaacatgctgctccataggatgcccgatgacttgcctaatgtcatctcctactcagtgattctcaagagtttcagcgacagtgggaggagccagcttgcgcttgacctgctccaaatgatggccaaaaaaggtgctgaccactcccccgacgtgatgtcatacaacatagtaattgatggcttttttaaagagggtgaagtaagcaaagcatgcgatctattccaagaaatgatacgacaggggattgtgcctactaaggtgacatatatctccattatcaatgcgctgtgcaaagcaagagcaatggacaaggtagaggtggttcttcgatcaatggttcataatggtgtccaaccagaagctgtgacatatagtagcatgatccaaggatattcaactttgggccagttgaaagaagttgctaggttgttgcaagtaatgagaagccaatgttgtatgccaaatgttgttacttgcagctcagtcatggattacctttgcaagcatggaagaatcaaagaagccgaggaaatattttattccatggccgtgaatggacgaaaacctaatgtcatctcatactctattatgctccatgggtacgctatagaaggaacccttattaaaatgattgatctctgtgagctgatggcaagagatggagttgtacccgacctccgttgtttcaacatactgattaatgcatatgctaagtatggcatgatggatgtggccatgcttttctttgaagacatg

SEQ ID NO: 2340 - DNA, 1209 bp, Triticum aestivum; identical to SEQ ID NO: 2339

SEQ ID NO: 2341 - DNA, 1209 bp, Triticum aestivum; identical to SEQ ID NO: 2339

SEQ ID NO: 2342 - DNA, 1209 bp, Triticum aestivum; identical to SEQ ID NO: 2339

SEQ ID NO: 2343 - DNA, 1209 bp, Triticum aestivum; identical to SEQ ID NO: 2339

SEQ ID NO: 2344 - DNA, 1209 bp, Triticum aestivum; identical to SEQ ID NO: 2339

SEQ ID NO: 2345 - DNA, 1443 bp, Triticum aestivum
atgtgcaaggttcatgcaatggacaaggctgaggaggttcttcaacagatgcttgatagaagaattctgccagatgctgccacatataatagtctgatacatggatattatttattaggacagtgcgaagaggtggatcgggttctcaaggaaatgtgtagaaagagtgttcaaccaaatattgtaacttactatatacagatggattatctttgcaagagcggaaggtgcgcagaagctaggaaaatatttgattctatgatcggtttgggccaaaaaccagatgttactacctacagtattctactgcatgggtatgctatggaaaaatcttttcatgagatgcattgtctcattgatttgatggtagaaaatggtattgcaccagatcatcatgtctacaacatactcatatctgcatatgctaaagaagaaagggttggtgaggtagtgcatatatttacaaaaatgcggcagcaaggattgaaccctaatgtagcgaactatggagtggttgtaaacttgctttgcagcatgggccgaatggatgatgctatgtcccaatacaatcaaatgataactgaaggattactccctggtatcatacttttcagccaacttattagtggtttctgtacttgtggcaaatgggagaaggttcatgaactattttctgagatgttggatcgtggcatctatcccgacactgtgttcttcaacacaattatggatcatctttgcaaaaatggaagggttatggaagcccaggatctcttcgacctgatggtacacatgggtgtgaaacctgacgtgtgtacttatagcacactgataggtggatacttgttcgttggtaagatggatgaagtgagcaagttacttgacaatatggtctcaattggcatggatccagatgttatcacctatagcatactgattgatggttactgtaagaatggaaggatagatgatgcattggttgttttcagggaaatgttggccgggaaggttaagccttgcattatcacttttaatattatgattggtgcgttgcttaaaggtggcagaaaggaagaggctaaagatttgtttgatggtatctgggccaaaggattagtgcccaccgttgttacatatagcttaatgatacaaaaacttatagaagaaggttctctacaggagtctgatgatctattcctttctatggagaagaatggttgtcctgccaattcccgcatgctaaatgctatagttagaaggttacttcagaaaggggagatgcccagggctgggacttatttgtctaaaattgatgagaggaatttcacccttgaagcttccacaactagcttgttgactgcacttgcttcagtggggaaatgtcaggaatataaggggttactgcctgaaaaatatcactcttttctggaacaaggcactgat

SEQ ID NO: 2346 - DNA, 1443 bp, Triticum aestivum; identical to SEQ ID NO: 2345

SEQ ID NO: 2347 - DNA, 1443 bp, Triticum aestivum; identical to SEQ ID NO: 2345

SEQ ID NO: 2348 - DNA, 1443 bp, Triticum aestivum; identical to SEQ ID NO: 2345

SEQ ID NO: 2349 - DNA, 1443 bp, Triticum aestivum; identical to SEQ ID NO: 2345

SEQ ID NO: 2350 - DNA, 1443 bp, Triticum aestivum; identical to SEQ ID NO: 2345

SEQ ID NO: 2351 - DNA, 1446 bp, Triticum aestivum
atgagccgccgctttgtccccgtcggcagacgcatcttagagcagaacatcaaggctcggtaccacgccggagacattggcaccgaggacgcactccacctgtttgacgaattgctccaggttgctgggcgctcctcgatccatgccatcaactgcctcctcaccgttgtctgccgtgattgccctgcgctcggcgtctccctcttcaaccgcgtcgcaaggtccaaggtggcgcccagcagtatcacctatgccattctggtcgactgctgctgccgcgctggccgcctggaccttggacacactgccatgggacacatcatcaagacgggatttgcagcagaagccatcgtcaatttcaaccacctactcaaggccatctgtgcagagaacaagaccagctatgcaatggacatcgtactccgaataatgcccatgtttaactgtgtacccaacattttctcctacagcattcttttcaagggtctctgcaacgagaagaggagtcaagaggctctcgagctgattaacatgatggttgaggatggaggtagctgccgacctgatgtggtgacctataacaccgtgattgatggcttgttgaaagagggtgaggtaggcaaggcttacagcctattttgtgaaatgctgcgtcagggggtatcgccggatgctgtgacctgtagttcaatcatctctggcatgtgcaagcttcatgcaatggacaaggctgaggaggttcttcaacagatgcttgatagaagaattctgccaaatgttgccacatataatagtctgatacatggatattatttattaggacagtgcgaagaggtggatcggattttcaaggaaatgtctagaaatggtgttcaaccaaatgttgtaacttacaatatacagatggattatctttgcaagagcggaagatgcgcagaagctaggaagatttttgattctatgatcagtttgggccaaaaaccgaatgtttatacctacagcgttctactgcatgggtatgctatggaaaaatcttttcatgatatgcattgtctcattgatttgatggtagaaaatggtattgcaccagatcatcatgtctacaacatactcatatctgcatatgctaaagaagaaatggttggtgtggtaatgcatatatttacgaaaatgcggcagcaaggattgaaccctgatgcagtgagctacggagcagtaatagacttactttgcagcatgggccgaatggatgatgctatgtcccaatacaatcaaatgataactgaaggattactccctggtatcatagttttcaccccccttattagtggtttctgttcttgtggcaaatgggagaaggttgatgaactattttctgagatgttggatcgcggcatttgtcccaacagtgttcttcaacacaattatggaccgcctttgcaaaaa

SEQ ID NO: 2352 - DNA, 1446 bp, Triticum aestivum; identical to SEQ ID NO: 2351

SEQ ID NO: 2353 - DNA, 1446 bp, Triticum aestivum; identical to SEQ ID NO: 2351

SEQ ID NO: 2354 - DNA, 1446 bp, Triticum aestivum; identical to SEQ ID NO: 2351

SEQ ID NO: 2355 - DNA, 1446 bp, Triticum aestivum; identical to SEQ ID NO: 2351

SEQ ID NO: 2356 - DNA, 1446 bp, Triticum aestivum; identical to SEQ ID NO: 2351

SEQ ID NO: 2357 - DNA, 1470 bp, Triticum aestivum
atgtcgcgcctccatccccgctacttctccagctccatctcctcactcgccgacgagctgctgagcgaactccaccatcatctgggctcagggacgctcagtccgcagctcgcacaccaactgttcgacgaaatgctgcgccaacccgtcccagtatcatcgcgtgcactcaatggcttatttgctgccctcgcgcgtacgccaccctccaccacctgcacagatagccctgccctcgccatcaatctcttcaaccgcatggcccgagcaggtcgcggcagggtgatagcacccagcagtcacacctacagcatactaattgaatgctgctgcctcgcgcgccgtccggaccttgggccttccttcttcgctcacctcctcaagacaggcgtcacggcagacgtcgtcatcttcagtggcttattcaagtgcctctgtgacatgaagcgggcagacgaggctcaggacatactgctccataggatacctgacgacctgcatgatgccatctcctactcagtaattctcaagagcttctgcaacaatggattgagccagcgtgcgcttgacctgctccggatgatggccaaaaaaggtgctgaccactccccgggtgtgtttgcatacagcatggtaatccatggcttctttaaagagggtgaagtaagcaaagcatgcgatctattccatgaaatgatacaacaggggcctgtgcctaatgtggtgacgtacaactctgttatcgatgcgctatgcaaagcaagagcaatggacaaggcagaggtggttcttcgatcaatggttcataatggtgtccaaccaaatgttgtgacatataatagcttgatccaaggatattcaactgtgggacagttgaaagaagtcgctaggttgttgaaagtgatgagaagccaaggtgttatgccaagtgttgttacctacaactcactcatgggctacctttgcaagcatggaagaatcaaagaagctgaggaaatatttttttccatgaccctgaatggccgaaaaccagatatagtctcatactctattatgctccgtgggtacgctatagaaggatcccttgttaaaatgattgatctctgtgagctgatggcaagagatggagttgtacctgaactccattgtttcaacatactgattagtgcatatgctaagtatggaatgatggatgtggctatgcttttctttgaagacatgttgaagcaggggctgaaccctggtgatttcatttatttaactgtgatatctgcattttgtaagatgggcaggatggatgatgctctggaaaaattcaatgagatgattgataggggggtaccacttgacacaaaaatttacatgtgcatgattgagggttatttgaatcgtggtgattctgtgaaagccgaggaatttattaccaaaatgaagagtagggatattcgtcataggccgcggaagggtaat

SEQ ID NO: 2358 - DNA, 1470 bp, Triticum aestivum; identical to SEQ ID NO: 2357

SEQ ID NO: 2359 - DNA, 1470 bp, Triticum aestivum; identical to SEQ ID NO: 2357

SEQ ID NO: 2360 - DNA, 1470 bp, Triticum aestivum; identical to SEQ ID NO: 2357

SEQ ID NO: 2361 - DNA, 1470 bp, Triticum aestivum; identical to SEQ ID NO: 2357

SEQ ID NO: 2362 - DNA, 1470 bp, Triticum aestivum; identical to SEQ ID NO: 2357

SEQ ID NO: 2363 - DNA, 888 bp, Triticum aestivum
atggccaaaaaaggtgctgaccactcccccaacgtggtgtcatacaacacggtaatcaatggcttctttaaggagggcgaagtaagcaaagcatgcaatctattccacgaaatgatacaacagggggttgtgcctaatgaggtgacatatagctccattatcaatgcactatgcaaagcaagagcaatggataaggcagaggtgatccttcgacatatggttcatagtggtgtccaaccacatgataggatatataatatcctgatccatggatttttaacttcgggtcagctgaaagaagcctttaggctgttgaaactgatgacaagccaaggtgttatgccaaaccttgttacctgcaactcagtcatgacctaccattgcaagaatggaagagtaaaagaagctgcggaaatattttattccatggctgtgaagggccgaaaacctaatgtcatctcatactctattatgcttcatgggtacgcgacagaaggatcccttgttgaaatgattgatctctgtgagctgatggcaagagatggagttgtacccgaccgctctgttttcaacatactgattaaggcatatgctaaacatggaatgatcgatgtggctatgcttttctttgatgaaatgttgaagcagggggtgaaccctaatgatatcacatatttaactctgatatctgcattttgcaagatgggcagaatggatgatgccatgatcaaattcaatgagatgattgatatgggaataccacatgatacaactgtttacatgtgcatgattgagggttatttgaatcatggtgattccgtgaaagccaaggaatttattactaaaatgaagagcagggatgtttgtcatagcccgcggaagggtaat

SEQ ID NO: 2364 - DNA, 888 bp, Triticum aestivum; identical to SEQ ID NO: 2363

SEQ ID NO: 2365 - DNA, 888 bp, Triticum aestivum; identical to SEQ ID NO: 2363

SEQ ID NO: 2366 - DNA, 888 bp, Triticum aestivum; identical to SEQ ID NO: 2363

SEQ ID NO: 2367 - DNA, 777 bp, Triticum aestivum
atgatacaacagggggttgtgcctaatgaggtgacatatagctccattatcaatgcactatgcaaagcaagagcaatggataaggcagaggtgatccttcgacatatggttcatagtggtgtccaaccacatgataggatatataatatcctgatccatggatttttaacttcgggtcagctgaaagaagcctttaggctgttgaaactgatgacaagccaaggtgttatgccaaaccttgttacctgcaactcagtcatgacctaccattgcaagaatggaagagtaaaagaagctgcggaaatattttattccatggctgtgaagggccgaaaacctaatgtcatctcatgctctattatgcttcatgggtacgcgacagaaggatcccttgttgaaatgattgatctctgtgagctgatggcaagagatggagttgtacccgaccgctctgttttcaacatactgattaaggcatatgctaaacatggaatgatcgatgtggctatgcttttctttgatgaaatgttgaagcagggggtgaaccctaatgatatcacatatttaactctgatatctgcattttgcaagatgggcagaatggatgatgccatgatcaaattcaatgagatgattgatatgggaataccacatgatacaactgtttacatgtgcatgattgagggttatttgaatcatggtgattccgtgaaagccaaggaatttattactaaaatgaagagcagggatgtttgtcatagcccgcggaagggtaat

SEQ ID NO: 2368 - DNA, 633 bp, Triticum aestivum
atgtcgcgcctccacccccgctacttctccagctccatcccctcactcgccgacgagctgctgagcgaactccaccatcatctgggctctgggacgctcagtccgcagctcgcacaccaactgttcgacgaaatgctgcgccaacccgtcccagtatcatcgcgtgcgctcaatggcttatttgctgccctcgcgcgtacgccgccctccaccacctgcacagatagccctgccctcgccatcaatctcttcaaccgcatggcccgagcaggtcgcggcagggtgatagcacccagcagtcacacctacagcatactaattgaatgctgctgcctcgcgcgccgtccggaccttgggccttccttcttcgctcacctcctcaagacaggcgtcacggtagacgtcgtcaccttcagtggcttattcaagtgcctctgtgacatgaagcgcacggaggaggctctggatgtgctgcttcataaggtgcctcacaacctgcctaatgtcatctcctactcagtagttgtgaagagcttctgcgacaatggtaggagccagcttgcgcttgacctgctccgtataatggccaaaaaaggtgctgaccaccccccaacgtggtgtcatacaacacgg

SEQ ID NO: 2369 - DNA, 1470 bp, Triticum aestivum
atgtcgcgcctccacccccgctacttctccagctccatcccctcactcgccgacgagctgctgagcgaactccaccatcatctgggctctgggacgctcagtccgcagctcgcacaccaactgttcgacgaaatgctgcgccaacccgtcccagtatcatcgcgtgcgctcaatggcttatttgctgccctcgcgcgtacgccgccctccaccacctgcacagatagccctgccctcgccatcaatctcttcaaccgcatggcccgagcaggtcgcggcagggtgatagcacccagcagtcacacctacagcatactaattgaatgctgctgcctcgcgcgccgtccggaccttgggccttccttcttcgctcacctcctcaagacaggcgtcacggtagacgtcgtcaccttcagtggcttattcaagtgcctctgtgacatgaagcgcacggaggaggctctggatgtgctgcttcataaggtgccccacaacctgcctaatgtcatctcctactcagtagttgtgaagagcttctgcgacaatggtaggagccagcttgcgcttgacctgctccgtataatggccaaaaaaggtgctgaccactcccccaacgtggtgtcatacaacacggtaatcaatggcttctttaaggagggcgaagtaagcaaagcatgcaatctattccacgaaatgatacaacagggggttgtgcctaatgaggtgacatatagctccattatcaatgcactatgcaaagcaagagcaatggataaggcagaggtgatccttcgacatatggttcatagtggtgtccaaccacatgataggatatataatatcctgatccatggatttttaacttcgggtcagctgaaagaagcctttaggctgttgaaactgatgacaagccaaggtgttatgccaaacgttgttacctgcaactcagtcatgacataccattgcaagaatggaagagtaaaagaagctgcggaaatattttattccatggctgtgaagggccgaaaacctaatgtcatctcatactctattatgcttcatgggtacgcgacagaaggatcccttgttgaaatgattgatctctgtgagctgatggcaagagatggagttgtacccgaccgctctgttttcaacatactgattaaggcatatgctgaacatggaatgatcgatgtggctatgcttttctttgatgaaatgttgaagcagggggtgaaccctaatgatatcacatatttaactctgatatctgcattttgcaagatgggcagaatggatgatgccatgatcaaattcaatgagatgattgatatgggaataccacatgatacaactgtttacatgtgcatgattgagggttatttgaatcatggtgattccgtgaaagccaaggaatttattactaaaatgaagagcagggatgtttgtcatagcccgcggaagggtaat

SEQ ID NO: 2370 - DNA, 888 bp, Triticum aestivum; identical to SEQ ID NO: 2363

SEQ ID NO: 2371 - DNA, 1479 bp, Triticum aestivum
atgtcacgcctccagccccgctatttctccagctccgtgtcctcacgcgccaacgaactgctgagcgaattccaccatcatctgggctccggaacgctctggccggagctcgcgcgccaactgttcgaccaaatgctgcgccaacctgtcccggtatcagtacgtgcactcaacggcttatttgctgccctcgcgcgtgcgccgccctcaaccgcctgcaccaatgcccctgccctcgtcattgatctcttcaaccgcatggcccaagcaggtcgtcgccaggtgacagcacccaccatttacacctacagcatacttattgagtgctgccaccgagcatgccgcccagacctagggcttgccttcttcggccgcctcctccagacaggcatcacgacggacgtcattacctacagcagcttactcaagtgcctctgtgacatgaagcgcacggaggaggctttgggcgtgctgctccacaggatgcccaacgacctgcctaatgtcatctcctactcagtaattctcaagagcttctgcgacagtggtaggagccagcttgcgcttgatctgctccgaatgatggccgaaaaaggatctgaccactcccccagcgtggtgtcatacagcgtggtaatcgatggtttcttcaaggagggtgaaataagcaaagcatgtgatctgttccatgaaatgatgcagcagggggttgtgcccgatgtggtgatgtatacctccattatcaatgcgctatgcaaagcaagagcaatggacaaggcagaggtggttcttcgatcaatggttcataatggtgtccaaccagatgctgtgacatatactagcctgatccaaggatattcaactttaggccagttgaaagaagtcgctaggttgttgaaagtgatgagaagccaaggtgttatgccagacgttgttacctgcaccttagtcatggactacctttgcaagcatggaagaaccaaagaagctcaggaaatattttattccatggctgtgaatgggcaaaaacctgatattgtcgcatactgtactatgctctatgggtactctatagaaggatcccttgttgatatgatcgatctctgtgagctgatggcaagagatggagttgtacccaacctccgttgtttcaacatactgattaatgcatatgctaagcatggaatgatggatgtggccctgcttttcttcgaagatatgttgaagcagggggtgaagcctaatgaattcacttatttaactgtgatatctgcattttgcaagatgggcaggatggatgatgcgatggaaaaattccgtgagatgattgatatgggagtaccagttgacacagaagtttacatgtgcatgattgagggttatttgaatcacggtgactccgtgaaagcgaaggaattgattactgaaatgaagaacacggatattcgtcataagccgtggaagggtaatggaagaaca

SEQ ID NO: 2372 - DNA, 1479 bp, Triticum aestivum; identical to SEQ ID NO: 2371

SEQ ID NO: 2373 - DNA, 1479 bp, Triticum aestivum; identical to SEQ ID NO: 2371

SEQ ID NO: 2374 - DNA, 1479 bp, Triticum aestivum; identical to SEQ ID NO: 2371

SEQ ID NO: 2375 - DNA, 1479 bp, Triticum aestivum; identical to SEQ ID NO: 2371

SEQ ID NO: 2376 - DNA, 1479 bp, Triticum aestivum; identical to SEQ ID NO: 2371

SEQ ID NO: 2377 - DNA, 1134 bp, Triticum aestivum
atgccgcccagatcttggcctgccttcttcggccgcctcctcaagacaggcatcacgaaggacgtcgttacctacagcagcttattcaagtgcctctgcgacatgaagcgcacagaggaggctctgaacgtgctgctccataagatgcccgacgacctgcctaatgtcatctcctactcagtgattctcaagagcttctgcgacagtggtaggagccagctcgcgcttgacctgctccggatgatggccgaaaaaggatctggccactcccccagcgtggtgtcatacagcatggtaatcgatggtttcttcaaggagggtgaaataagcaaagcatgcgatctattccatgaaatgatacaacatggggttgtgcctactgtggtgacatataactccattattgatgcgcggtgcaaagcaagagcaatggacaaggcagaggtggttcttcgatcaatggttcataatggtgtccaaccagatgctgtgacatataattgcttgatccaaggatattcaactttgggccagttgaaagaagtcgctaggttgttgaaagtgatgagaagccaaggtgttctaccagatgttgttacctacaactcactcatgacctgcctttgcaagaatggaagattaaaggaagctgtagtttttttttattccatggccatgaacggccaaaaacctgatgtcatctcatactctgttttgctccatgggtacgctaaagaaggatccctcattgatatgattgatctctgtgagcggatggcaagagatggagttgtacccaacctccattgtttcaacatactgattagtgcatatgctaagtatggaaggatggatgtggctatgcttttcttcgaagacatgttgaagaaggggttgaaccctaatgaattcatttatttaactgtcatatctgcattttgcaagatgggcaggatggatgatgctctggaaaaattcaatgagatgattgatagaggagtaccacttgacataaaaatttacatgtgcatgattgagggttatttgaatcatggtgattctgtgaaagccgaggaatttattaccaaaatgaagagcagggatattcatcataggccgcggaagggtaattgt

SEQ ID NO: 2378 - DNA, 1134 bp, Triticum aestivum; identical to SEQ ID NO: 2377

SEQ ID NO: 2379 - DNA, 1134 bp, Triticum aestivum
atgccgcccagatcttggcctgccttcttcggccgcctcctcaagacaggcatcacgaaggacgtcgttacctacagcagcttattcaagtgcctctgcgacatgaagcgcacagaggaggctctgaacgtgctgctccataagatgcccgacgacctgcctaatgtcatctcctactcagtgattctcaagagcttctgcgacagtggtaggagccagctcgtgcttgacctgctccggatgatggccgaaaaaggatctggccactcccccagcgtggtgtcatacagcatggtaatcgatggtttcttcaaggagggtgaaataagcaaagcatgcgatctattccatgaaatgatacaacatggggttgtgcctactgtggtgacatataactccattattgatgcgcggtgcaaagcaagagcaatggacaaggcagaggtggttcttcgatcaatggttcataatggtgtccaaccagatgctgtgacatataattgcttgatccaaggatattcaactttgggccagttgaaagaagtcgctaggttgttgaaagtgatgagaagccaaggtgttctaccagatgttgttacctacaactcactcatgacctgcctttgcaagaatggaagattaaaggaagctgtagtttttttttattccatggccgtgaacggccaaaaacctgatgtcatctcatactctgttttgctccatgggtacgctaaagaaggatccctcattgatatgattgatctctgtgagcggatggcaagagatggagttgtacccaacctccattgtttcaacatactgattagtgcatatgctaagtatggaaggatggatgtggctatgcttttcttcgaagacatgttgaagaaggggttgaaccctaatgaattcatttatttaactgtcatatctgcattttgcaagatgggcaggatggatgatgctctggaaaaattcaatgagatgattgatagaggagtaccacttggcataaaaatttacatatgcatgattgagggttatttgaatcatggtgattctgtgaaagccgaggaatttattaccaaaatgaagagcaggggtattcgtcataggccgcggaagggtaattgt

SEQ ID NO: 2380 - DNA, 1473 bp, Triticum aestivum
atgtcacgcctccaggtccgctctctctccagctccttctcctcacgcgcctacgagctgctgaacgaactcgacggccgtctgggctccgggacgctcagcccagagcccgcgcgcgaactgttcgacgaaatgctgcgccaaccagtcccagtatcagtacgtgcactcaacggcttatttgctgccctttcgcgtgcgccgccctccaccatctacaccaatgcccctgccctcgccattgatctcttcaaccgcatggcccaagcaggccgtcgccaggtgacagcacctgacatttacacctacaacatactaattgactgctgccaccgagcatgccgcccggatcttgggcctgccttcttcggccgcctcctcaagacaggcatcacgaaggacgtcgttacctacagcagcttattcaagtgcctctgcgacatgaagcgcacagaggaggctctgaacgtgctgctccataagatgcctgacgacctgcctgatgccatctcctactcagtgattctcaagagcttctgcgacagtggtaggagccagctcgcgcttgacctgctccggatgatgaccgaaaaaggatctggccactcccccagcgtggtgtcatacagcatggtaattgatggtttcttcaaggagggtgaaataagcaaagcatgcgatctattccatgacatgatacaacatggggttgtgcctactgtggtgacatataactccattattgatgcgcggtgcaaagcaagagcaatggacaaggcagaggtggttcttcgatcaatggttcataatggtgtccaaccagatgctgtgacatataattgcttgatccaaggatattcaactttgggccagttgaaagaagtcgctaggttgttgaaagtgatgagaagccaaggtgttctaccagatgttgttacctacaactcactcatgacctgcctttgcaagaatggaagattcaaggaagctgtagaaattttttattccatggccgtgaacggccaaaaacctgatgtcatctcatactctgttttgctccatgggtacgctaaagaaggatccctcgttgatatgattgatctctgtgagcggatggcaagagatggagttgtacccaacctccattgtttcaacatactgattagtgcatatgctaagtatggaaggatggatgtggctatgcttttcttcgaagacatgttgaagaaggggttgaaccctaatgaattcatttatttaactgtcatatctgcattttgcaagatgggcaggatggatgatgctctggaaaaattcaatgagatgattgatagaggagtaccacttgacataaaaatttacatgtgcatgattgagggttatttgaatcatggtgattctgtgaaagccgaggaatttattaccaaaatgaagagcagggatattcgtcataggccgcggaagggtaattgt

SEQ ID NO: 2381 - DNA, 1134 bp, Triticum aestivum; identical to SEQ ID NO: 2377

SEQ ID NO: 2382 - DNA, 1134 bp, Triticum aestivum; identical to SEQ ID NO: 2377

SEQ ID NO: 2383 - DNA, 1134 bp, Triticum aestivum; identical to SEQ ID NO: 2379

SEQ ID NO: 2384 - DNA, 1470 bp, Triticum aestivum
atgtcacgccttcaggtccgctcttactctagccccgtttcctcacgcgccaacgatctgctgaccgaactccacggccatatgggcttcgggacgctcaggccagagctcgcgcaccaactgttcgacgaaatgttgggccaacctgtcccagtatcggtgcgtgcactcaacggcttatttgctgcactcgcgcgtgcgccgccctcaaccgcctgcactgatggccctgccctcgccgttgatctcttcaaccatatggcccgagcaggccgccgctggatgacagcacccaccattcacacctacaacatactaattgactgctgccaccgagcatgccgcccagacctagggcccgccttcttcggctgcctcctcaagacaggagtcacaacgagccccattacctacagcagcctattcaagtgcctctgtgacatgaagcgcacagaggaggctctggacatactgctccataggatagccgacgacctgcctaatgtcatctcctactcagtgattctcaagagtttctgcgacaatgggaggagccagcttgcgcttgacctgctccgggtgatggccaaaaaaggtggtgaccgctctcccgacgtgatgttatacaacatggtaatcgatggcttctttaaggagggtgaagtaagcaaagcatgcgatctattccatgaaatgatacaacagggggtagtgcctactgaggtgacatatagctccattatcaatgcgctatgcaaagcaagagcaatggacaaagcagaggtggtccttcgacatatggttcataatggtgtccaaccagatgttgtgacatatactagcctgatcaaaggatattcaactttaggccagttaaaagaagtcgctaggttgttgaaagtaatgagaagccaaggtgttatgccaggcattgttacctataccttagtcatggactacctttgcaagcatggaagaatcaaagaagctgaggaaatattttattccatggccgtgaatggccaaaaacgagatacggtctcatactctattatgctccatgggtacgctatagaaggatcccttgttcaaatgattgatctctgtgagctgatggcaagagatggagttgtacctgacctccgttgtttcaacatactgattaatgcatatgctaagtatggcatgatggatgcggccatgcttttctttgaagacatgttgaagcagggtgtgaagcctaatgaattcacttatttaactgtgatatctgcattttgcaagatgggcaggatggatgatgcgatggaaaaattcaatgagatgattgatatgggagtaccacttgacacagaagtttacatgtgcatggttgagggttattttaatcttgatgattccataaaagccaaggaatttattaccaaattgaagaacagggatattcatcataggccgcggaaaggtaat

SEQ ID NO: 2385 - DNA, 1470 bp, Triticum aestivum; identical to SEQ ID NO: 2384

SEQ ID NO: 2386 - DNA, 1470 bp, Triticum aestivum; identical to SEQ ID NO: 2384

SEQ ID NO: 2387 - DNA, 1470 bp, Triticum aestivum; identical to SEQ ID NO: 2384

SEQ ID NO: 2388 - DNA, 1470 bp, Triticum aestivum; identical to SEQ ID NO: 2384

SEQ ID NO: 2389 - DNA, 1470 bp, Triticum aestivum
atgtcacgccttcaggtccgctcttactctagccccgtttcctcacgcgccaacgatctgctgaccgaactccacggccatatgggcttcgggacgctcaggccagagctcgcgcaccaactgttcgacgaaatgttgggccaacctgtcccagtatcggtgcgtgcactcaacggcttatttgctgcactcgcgcgtgcgccgccctcaaccgcctgcactgatggccctgccctcgccgttgatctcttcaaccatatggcccgagcaggccgccgctggatgacagcacccaccattcacacctacaacatactaattgactgctgccaccgagcatgccgcccagacctagggcccgccttcttcggctgcctcctcaagacaggagtcacaacgagccccattacctacagcagcctattcaagtgcctctgtgacatgaagcgcacagaggaggctctggacatactgctccataggatagccgacgacctgcctaatgtcatctcctactcagtgattctcaagagtttctgcgacagtgggaggagccagcttgcgcttgacctgctccgggtgatggccaaaaaaggtggtgaccgctctcccaacgtgatgtcatacaacatggtaatcgatggcttctttaaggagggtgaagtaagcaaagcatgcgatctattccatgaaatgatacaacagggggtagtgcctactgaggtgacatatagctccattatcaatgcgctatgcaaagcaagagcaatggacaaagcagaggtggtccttcgacatatggttcataatggtgtccaaccagatgttgtgacatatactagcctgatcaaaggatattcaactttaggccagttaaaagaagtcgctaggttgttgaaagtaatgagaagccaaggtgttatgccagacattgttacctataccttagtcatggactacctttgcaagcatggaagaatcaaagaagctgaggaaatattttattccatggccgtgaatggccaaaaacgagatacggtctcatactctattatgttccatgggtacgctatagaaggatcccttgttcaaatgattgatctctgtgagctgatggcaagagatggagttgtacctgacctccgttgtttcaacatactgattaatgcatatgctaagtatggcatgatggatgcggccatgcttttctttgaagacatgttgaagcagggtgtgaagcctaatgaattcacttatttaactgtgatatctgcattttgcaagatgggcaggatggatgatgcgatggaaaaattcaatgagatgattgatatgggagtaccacttgacacagaagtttacatgtgcatggttgagggttattttaatcttgatgattccataaaagccaaggaatttattaccaaattgaagaacagggatattcatcataggccgcggaaaggtaat

SEQ ID NO: 2390 - DNA, 702 bp, Triticum aestivum
atggacaaggcagaggtggttcttcgatcaatggttcataatggtgcccaaccagatgctgtgacatataatagcttgatccaaggatattcaactttgggacagttgaaagaagtcgctaggttgttgaaagtgatgagaagccaaggtgttatgccaagcgttgttacctgcaactcactcatgacctgcctttgcaagaatggaagattcaaggaagctgtagaatttttttattccatggccgtgaacggccaaaaacctgatgtcatctcatactctgttttgctccatgggtacgctaaagaaggatccctcattgatatgattgatctctgtgagcggatggcaagagatggagttgtacccgacctccattgtttcaacatactgattagtgcatatgctaagtatggaaggatggatgtggctatgcttttcttcgaagacatgttgaagaaggggttgaaccctaatgaattcatttatttaactgtcatatctgcattttgcaagatggacaggatggatgatgctctggaaaaattcaatgagatgattgataggggagtaccacttgacacaaaaatttacatgtgcatgattgagggttatttgaaccatggtgattctgtgaaagccgaggaatttattaccaaaatgaagagcagggatattcgtcataggccgtggaagggtaat

SEQ ID NO: 2391 - DNA, 1212 bp, Triticum aestivum
atggcccgagcaggccgtcgccaggcgacagcacccaccatttacacctacagcatactaatggagtgttgccaccgagcatgccgcccagacctagggcttgccttcttcggccgcctcctcaagacaggcatcccgacaaacatcattgactacagcagcttgttcaagtgcctctgtgacatgaagcgcacagaggaggctctgaacgtgctgctccataagatgcccgacgacctgcctaatgtcatctcatactcagtgattctcaagagcttctgcgacaatgggaggagccagcttgcgcttgatctgctccagatgatggccaaaaaaggcgctgaccactcccccgacgtgatgtcatacaacatggtaattgatggcttctttaaggagggtgaagtaagcaaagcatgcgatctattccaagaaatgatacgacaggggattgtgccaactgaggtgacatatagctccattatcaatgcgctatgcaaagcaagagcaatggacaaggcagaggtggttcttcgatcaatggttcataatggtgcccaaccagatgctgtgacatataatagcttgatccaaggatattcaactttgggacagttgaaagaagtcgctaggttgttgaaagtgatgagaagccaaggtgttatgccaagcgttgttacctgcaactcactcatgacctgcctttgcaagaatggaagattcaaggaagctgtagaatttttttattccatggccgtgaacggccaaaaacctgatgtcatctcatactctgttttgctccatgggtacgctaaagaaggatccctcattgatatgattgatctctgtgagcggatggcaagagatggagttgcacccgacctccattgtttcaacatactgattagtgcatatgctaagtatggaaggatggatgtggctatgcttttcttcgaagacatgttgaagaaggggttgaaccctaatgaattcatttatttaactgtcatatctgtattttgcaagatgggcaggatggatgatgctctggaaaaattcaatgagatgattgataggggagtaccacttgacacaaaaatttacatgtgcatgattgagggttatttgaaccatggtgattctgtgaaagccgaggaatttattaccaaaatgaagagcagggatattcgtcataggctgtggaagggtaat

SEQ ID NO: 2392 - DNA, 801 bp, Triticum aestivum
atgtcacgctttcaggtccgctctttctctagctccgtttcctcacgcgcccacgaactgctggacgaactccacgaccatctgggcttcagaacgctcaggccagagctcgcgcaccaactgttcgacgaaatgctgcgccaacctgtcccagtatcagctcgtgcactcagcggcttatttgctgcacttgcgcgtgcgccgccctcacctgcgtgcaccgatagccctgccctcgccattgatctgttcaaccgcatggcccgagcaggccgtcgccaggcgacagcacccaccatttacacctacagcatactaatggagtgttgccaccgagcatgccgcccagacctagggcttgccttcttcggccgcctgctcaagacaggcatcaagatggatggcattacctacagcagcttgttcaagtgcctctgtgacatgaagcgcacagaggaggctctgaacgtgctgttccataagatgcccgacgacctgcctaatgtcatctcatactcagtgattctcaagagcttatgcgacaatgggaggagccagcttgcgcttgatctgctccagatgatggccaaaaaaggcgctgaccactcccccgacgtgatgtcatacaacatggtaattgatggcttctttaaggagggtgaagtaagcaaagcatgcgatctattccaagaaatgatacgacaggggattgtgcctactgaggtgacatatagctccattatcaatgcgctatgcaaagcaagaggacaaggcagaggtggttcttcgatcaatggttca

SEQ ID NO: 2393 - DNA, 720 bp, Triticum aestivum
atgcgctatgcaaagcaagaggacaaggcagaggtggttcttcgatcaatggttcataatggtgcccaactagatgctgtgacatataatagcttgatgcaaggatattcaactttgggacagttgaaagaagtcgctaggttgttgaaagtgatgagaagccaaggtgttatgccaagcgttgttacctacaactcactcatgacctgcctttgcaagaatggaagattcaaggaagctgtagaatttttttattccatggccgtgaacggccaaaaacctgatgtcatctcatactctgttttgctccatgggtacgctaaagaaggatccctcattgatatgattgatctctgtgagcggatggcaagagatggagttgtacccgacctccattgtttcaacatactgattagtgcatatgctaagtatggaaggatgggtgtggctatgcttttcttcgaagacatgttgaagaaggggttgaaccctaatgaattcatttatttaactgtcatatctgcattttgcaagatgggcaggatggatgatgctctggaaaaattcaatgagatgattgataggggagtaccacttgacacaaaaaattacatgtgcatgattgagggttatttgaaccatggtgattctgtgaaagctgaggaatttattaccaaaatgaagagcagggatattcgtcataggccgtggaagggtaat

SEQ ID NO: 2394 - DNA, 801 bp, Triticum aestivum
atgtcacgctttcaggtccgctctttctctagctccgtttcctcacgcgcccacgaactgctggacgaactccacgaccatctgggcttcagaacgctcaggccagagctcgcgcaccaactgttcgacgaaatgctgcgccaacctgtcccagtatcagctcgtgcactcagcggcttatttgctgcacttgcgcgtgcgccgccctcacctgcgtgcaccgatagccctgccctcgccattgatctgttcaaccgcatggcccgagcaggccgtcgccaggcgacagcacccaccatttacacctacagcatactaatggagtgttgccaccgagcatgccgcccagacctagggcttgccttcttcggccgcctgctcaagacaggcatcaagatggatgtcattacctacagcagcttgttcaagtgcctctgtgacatgaagcgcacagaggaggctctgaacgtgctgttccataagatgcccgacgacctgcctaatgtcatctcatactcagtgattctcaagagcttatgcgacaatgggaggagccagcttgcgcttgatctgctccagatgatggccaaaaaaggcgctgaccactcccccgacgtgatgtcatacaacatggtaattgatggcttctttaaggagggtgaagtaagcaaagcatgggatctattccaagaaatgatacgacaggggattgtgcctactgaggtgacatatagctccattatcaatgcgctatgcaaagcaagaggacaaggcagaggtggttcttcgatcaatggttca

SEQ ID NO: 2395 - DNA, 1212 bp, Triticum aestivum
atggcccgagcaggccgtcgccaggcgacagcacccaccatttacacctacagcatactaatggagtgttgccaccgagcatgccgcccagacctagggcttgccttcttcggccgcctcctcaagacaggcatcccgacaaacatcattgactacagcagcttgttcaagtgcctctgtgacatgaagcgcacagaggaggctctgaacgtgctgctccataagatgcccgacgacctgcctaatgtcatctcatactcagtgattctcaagagcttctgcgacaatgggaggagccagcttgcgcttgatctgctccagatgatggccaaaaaaggcgctgaccactcccccgacgtgatgtcatacaacatggtaattgatggcttctttaaggagggtgaagtaagcaaagcatgcgatctattccaagaaatgatacgacaggggattgtgcctactgaggtgacatatagctccattatcaatgcgctatgcaaagcaagagcaatggacaaggcagaggtggttcttcgatcaatggttcataatggtgcccaaccagatgctgtgacatataatagcttgatccaaggatattcaactttgggacagttgaaagaagtcgctaggttgttgaaagtgatgagaagccaaggtgttatgccaagcgttgttacctgcaactcactcatgacctgcctttgcaagaatggaagattcaaggaagctgtagaatttttttattccatggccgtgaacggccaaaaacctgatgtcatctcatactctgttttgctccatgggtacgctaaagaaggatccctcattgatatgattgatctctgtgagcggatggcaagagatggagttgtacccgacctccattgtttcaacatactgattagtgcatatgctaagtatggaaggatggatgtggctatgcttttcttcgaagacatgttgaagaaggggttgaaccctaatgaattcatttatttaactgtcatatctgcattttgcaagatgggcaggatggatgatgctctggaaaaattcaatgagatgattgataggggagtaccacttgacacaaaaatttacatgtgcatgattgagggttatttgaaccatggtgattctgtgaaagccgaggaatttattaccaaaatgaagagcagggatattcgtcataggccgtggaagggtaat

SEQ ID NO: 2396 - DNA, 1470 bp, Triticum aestivum
atgtcacaatttcaggtccgctctttctctagctccgtttcctcacgcgcccacgagctgctggacgaactccacgaccacctgggcttcagaacgctcaggccagagctcgcgcaccaactgttcgacgaaatgctgtgccaacctgtcccagtatcagctcgtgcactcagcggcttatttgctgcacttgcgcgtgcgccgccctcacctgcgtgcaccgatagccctgccctcgccattgatctcttcaaccgcatggcccgagcaggccgtcgccaggcgacagcacccaccatttacacctacagcatactaatggagtgttgccaccgagcatgccgcccagacctagggcttgccttcttcggccgcctgctcaagacaggcatcaagacggatgtcattacctacagcagcttgttcaagtgcctctgtgacatgaagcgcacagaggaggctctgaacgtgctgttccataagatgcccgacgacctgcctaatgtcatctcatactcagtgattctcaagagcttctgcgacaatgggaggagccagcttgcgcttgatctgctccagatgatggccaaaaaaggcgctgaccactcccccgacgtgatgtcatacaacatggtaattgatggcttctttaaggagggtgaagtaagcaaagcatgcgatctattccaagaaatgatacgacaggggattgtgcctactgaggtgacatatagctccattatcaatgcgctatgcaaagcaagagcaatggacaaggcagaggtggttcttcgatcaatggttcataatggtgcccaaccagatgctgtgacatataatagcttgatccaaggatattcaactttgggacagttgaaagaagtcgctaggttgttgaaagtgatgagaagccaaggtgttatgccaagcgttgttacctgcaactcactcatgacctgcctttgcaagaatggaagattcaaggaagctgtagaatttttttattccatggccgtgaacggccaaaaacctgatgtcatctcatactctgttttgctccatgggtacgctaaagaaggatccctcattgatatgattgatctctgtgagcggatggcaagagatggagttgtacccgacctccattgtttcaacgtactgattagtgcatatgctaagtatggaaggatggatgtggctatgcttttcttcgaagacatgttgaagaaggggttgaaccctaatgaattcatttatttaactgtcatatctgcattttgcaagatgggcaggatggatgatgctctggaaaaattcaatgagatgattgataggggagtaccacttgacacaaaaatttacatgtgcatgattgagggttatttgaaccatggtgattctgtgaaagccgaggaatttattaccaaaatgaagagcagggatattcgtcataggccgtggaagggtaat

SEQ ID NO: 2397 - DNA, 801 bp, Triticum aestivum; identical to SEQ ID NO: 2392

SEQ ID NO: 2398 - DNA, 801 bp, Triticum aestivum; identical to SEQ ID NO: 2392

SEQ ID NO: 2399 - DNA, 720 bp, Triticum aestivum; identical to SEQ ID NO: 2393

SEQ ID NO: 2400 - DNA, 801 bp, Triticum aestivum; identical to SEQ ID NO: 2392

SEQ ID NO: 2401 - DNA, 801 bp, Triticum aestivum; identical to SEQ ID NO: 2394

SEQ ID NO: 2402 - DNA, 780 bp, Triticum aestivum
atgtcacgccttcaggtccgctctttctccagccccgtttcctcacgcgccaacgatctgctgaccgaactccacgcccatctgggcttcgggacgctcaggccagagctcgcgcaccaactgttcgacgaaatgctgcgccaacctgtcccagtatcagctcgtgcactcagcggcttatttgctgcactcgcgcgtgcgccgccctcaaccgcctgcactgatggccctgccctcgccatcgatctcttcaaccatatggccagagcaggccgccgctggatgacagcacccaccattcacacctacaacatactaattgactgctgccaccgagcatgccgcccagacctagggcctgccttcttcagccgcctcctcaagacaggcatcacaatgagcgtcattacctacagcagcttattcaagtgcctctgtgacatgaagcgcacggaggaggctttgggcgtgctgctccacaggatgcccgacgagctgcctgatgtcatctcctactcagtaattctcaagagcttctgcgacagtggtaggagccagcttgcgcttgatctgctccgaatgatggccgaaaaaggatctgaccactcccccagcgtggtgtcatacagcgtggtaatcgatggtttcttcaaggagggtgaaataagcaaagcatgtgatctgttccatgaaatgatgcagcagggggttgtgcccgatgtggtgatgtacacctccattatcaatgcgctatgcaaagcaagagcaatggacaaggca

SEQ ID NO: 2403 - DNA, 1470 bp, Triticum aestivum
atgtcacgccttcaggtccgctctttctccagccccatttcctcacgcgccaacgatctgctgaccgaactccacggccatctgggcttcgggacgctcaggccagagctcgcgcaccaactgttcgacgaaatgctgcgccaacctgtcccagtatcagcgcgtgcactcaacggcttatttgctgcactcgcgcgtgcgccgccctcaaccgcctgcactgatggccctgccctcgccgtcgatctcttcaaccatatggccagagcaggccgccgctggatgacagcacccaccattcacacctacaacatactaattgactgctgccaccgagcatgccgcccagacctagggcctgccttcttcagccgcctcctcaagataggcatcacaatgagcgtcattacctacagcagcttattcaagtgcctctgtgacatgaagcgcacggaggaggctttgggcgtgctgctccacaggatgcccgacgacctgcctgatgtcatctcctactcagtaattctcaagagcttctgcgacagtggtaggagccagcttgcgcttgatctgctccgaatgatggccgaaaaaggatctgatcactcccccagcgtagtgtcatacagtgtggtaatcgatggtttcttcaaggagggtgaaataagcaaagcatgtgatctgttccatgaaatgatgcagcagggggttgtgcccgatgtggtgatgtatacctccattatcaatgcgctatgcaaagcaagagcaatggacaaggcagaggtggttcttcgatcaatggttcataatggtgtccaaccagatgctgtgacatataatagcttgatccaaggatattcaactctgggacagttgaaagaactcgctaggttgttgaaagtgatgagaagccaaggtgttatgccaagcgttgttacctacaactcactcatgacctgcctttgcaagaatggaagattcaaggaagctgtagaaattttttatttgatggctatgaagggccaaaaacctgatctcatctcatactctattttgctccatgggtatgctaaagaaggatccctcattgatatgattgatctctgtgagcagatggcaagagatggagttgtacccgacctccattgtttcaacatactgattagtgcatatgctaagtatggaaggatggatgtggctatgcttttcttcgaagacatgttgaagaaggggttgaaccctaatgaaatcatttatttaactgtcatatctgcattttgcaagatgggcaggatggatgatgccctggaaaaattcaatgagatgattgataggggagtactacttgacacaaaaatttacatgtgcatgattgagggttatttgaaccatggtgattctgtgaaagccgaggaatttattaccaaaatgaagagcagggatattcgtcataggccgcggaagggtaac

SEQ ID NO: 2404 - DNA, 1452 bp, Triticum aestivum
atgtcgcgcctccagccccgctctttctccagccccgtctcctcacgagtcagcgagctgctggatgaattcaaatgtcatctgggttctgggacgctctggccggagctcgcgcaccaactgttcgacgaaatgctgcgccaacccgtcccggtttcagcacgcgcactcggcggcttattttctgccctcgcgcgtgcgcggccctcaaccgcctgtactgatggccccgccctcgccatcgatctcttcaaccgccaccggatagcacctgacatttacacctacaacatactaattgactgctgccaccgagcatgccgcccagacctagggcctgccttcttcggatgccttctcaagacaggcatcacgacggacgtcattacctacagcagtttattgcagtgcttctgtgacatgaagcggacagaggaagctctggacctgctgctccatattgtgagtgataacctgcctgatgccatctcctactcagtaattctcaagagcttctgcgacaacggaaggagccagtgtgcgcttgacctgctccagatgatggccaaaaaaggtgctgaccattcccccaacgtggtctcatacaacttggtaatcaatggtttctttaaggagggtgaaataagcaaagcatgtgatctgttccatgaaatgatacaacaagggtttgttcctgatgtggtgacatataactctgttattaatgcactgtgcaaagcaagagcaatggacaaggcagaggtggtccttcgatcgatggttcataatagtgtccaaccggatgttgtaacatataatagcttgatccaaggatttttaactacgggtcagctgaaagaagcctttaggttgttgaaagtgatgagaagccaaggtgttatgccaagcgttgttacttgcacctcggtcatggactacctttgcaagcatggaagaatcaaagaagctgaggaaacattttattccatggccgcgagtggccgaaaaccagatacagtctcatactctattatgctccttgggtacgctatagaaggatcccttgttaaaatgattgatctctgtgagatgatggcaagagatggagttgtacccgacctccgttgtttcaacatactgattaaggcatatgctaagtatggcaggatggatgtggccatgcttttctttgaagacatgttgaagcagggtgtgaagcctaatgaattcacttatttaactgtgatatctgcattttgcaagatgggcaggatggatgatgcgatggaaaaattcaatgagatgattgatatgggagtatcacttgacacagaagtttacatgtgcatggttgagggttattttaatcatggtgattccatgaaagccgaggaatttattaccaaaatgaagaacagggatattcatcataagccatggaaaggtaatcga

SEQ ID NO: 2405 - DNA, 1452 bp, Triticum aestivum
atgtcgcgcctccagccccgctctttctccagtcccgtctcctcacgagtcagcgagctgctggatgaattcaaatatcatctgggctctgggacgctctggccggagctcgcgcaccaactattcgacgaaatgctgcgccaacccgtcccggtttcagcacgcgcactcggcggcttattttctgccctcgcgcgtgcgcggccctcaaccgcctgtactgatggccccgccctcgccatcgatctcttcaaccgccaccggatagcacctgacatttacacctacaacatactaattaactgctgccaccgagcatgccgcccagacctagggcctgccttcttcggatgccttctcaagacaggcatcacgacggacgtcattacctacagcagtttattgcagtgcttctgtgacatgaagcggacagaggaagctctggacctgctgctccatagggtgagtgataacctgcctgatgccatctcctactcagttattctcaagagcttctgcgacaacggaaggagccagtgtgcgcttgacctgctccagatgatggccaaaaaaggtgctgaccattcccccaacgtggtctcatacaacttggtaatcaatggtttctttaaggagggtgaaataagcaaagcatgtgatctgttccatgaaatgatacaacaagggtttgttcccgatgtggtgacgtataactctgttattaatgcactgtgcaaagcaagagcaatggacaaggcagaggtggtccttcgatcgatggttcataatagtgtccaaccggatgttgtaacatataatagcttgatccaaggatttttaactacgggtcagctgaaagaagcctttaggttgttgaaagtgatgagaagccaaggtgttatgccaagcgttgttacttgcacctcagtcatggactacctttgcaagcatggaagaatcaaagaagctgaggaaacattttattccatggccgtgagtggccgaaaaccagatacagtctcatactctattatgctccttgggtacgctatagaaggatcccttgttaaaatgattgatctctgtgagatgatggcaagagatggagttgtacccgacctccgttgtttcaacatactgattaaggcatatgctaagtatggcaggatggatgtggccatgcttttctttgaagacatgttgaagcagggtgtgaagcctaatggattcacttatttaattgtgatatctgcattttgcaagatgggcaggatggatgatgcgatggaaaaattcaatgagatgattgatatgggagtaccacttgacacagaagtttacatgtgcatggttgagggttattttaatcatggtgattccatgaaagccgaggaatttattaccaaaatgaagaacagggatattcatcataagccatggaaaggtaatcga

SEQ ID NO: 2406 - DNA, 1452 bp, Triticum aestivum
atgtcgcgcctccagccccgctctttctccagccccgtctcctcacgagtcagcgagctgctggatgaattcaaatatcatctgggctctgggacgctctggccggagctcgcgcaccaactgttcgacgaaatgctgcgccaacccgtcccggtttcagcacgcgcactcggcggcttattttctgccctcgcgcgtgcgcggccctcaaccgcctgtactgatggccccgccctcgccatcgatctcttcaaccgccaccggatagcacctgacatttacacctacaacatactaattaactgctgccaccgagcatgccgcccagacctagggcctgccttcttcggatgccttctcaagacaggcatcacgacggacgtcattacctacagcagtttattgcagtgcttctgtgacatgaagcggacagaggaagctctggacctgctgctccatagggtgagtgataacctgcctgatgccatctcctactcagttattctcaagagcttctgcgacaacggaaggagccagtgtgcgcttgacctgctccagatgatggccaaaaaaggtgctgaccattcccccaacgtggtctcatacaacttggtaatcaatggtttctttaaggagggtgaaataagcaaagcatgtgatctgttccatgaaatgatacaacaagggtttgttcccgatgtggtgacgtataactctgttattaatgcactgtgcaaagcaagagcaatggacaaggcagaggtggtccttcgatcgatggttcataatagtgtccaaccggatgttgtaacatataatagcttgatccaaggatttttaactacgggtcagctgaaagaagcctttaggttgttgaaagtgatgagaagccaaggtgttatgccaagcgttgttacttgcacctcagtcatggactacctttgcaagcatggaagaatcaaagaagctgaggaaacattttattccatggccgtgagtggccgaaaaccagatacagtctcatactctattatgctccttgggtacgctatagaaggatcccttgttaaaatgattgatctctgtgagatgatggcaagagatggagttgtacccgacctccgttgtttcaacatactgattaaggcatatgctaagtatggcaggatggatgtggccatgcttttctttgaagacatgttgaagcagggtgtgaagcctaatggattcacttatttaattgtgatatctgcattttgcaagatgggcaggatggatgatgcgatggaaaaattcaatgagatgattgatatgggagtaccacttgacacagaagtttacatgtgcatggttgagggttattttaatcatggtgattccatgaaagccgaggaatttattactaaaatgaagaacagggatattcatcataagccatggaaaggtaatcga

SEQ ID NO: 2407 - DNA, 1452 bp, Triticum aestivum
atgtcgcgcctccagccccgctctttctccagccccgtctcctcacgagtcagcgagctgctggatgaattcaaatatcatctgggctctgggacgctctggccggagctcgcgcaccaactgttcgacgaaatgctgcgccaacccgtcccggtttcagcacgcgcactcggcggcttattttctgccctcgcgcgtgcgcggccctcaaccgcctgtactgatggccccgccctcgccatcgatctcttcaaccgccaccggatagcacctgacatttacacctacaacatactaattaactgctgccaccgagcatgccgcccagacctagggcctgccttcttcggatgccttctcaagacaggcatcacgacggacgtcattacctacagcagtttattgcagtgcttctgtgacatgaagcggacagaggaagctctggacctgctgctccatagggtgagtgataacctgcctgatgccatctcctactcagttattctcaagagcttctgcgacaacggaaggagccagtgtgcgcttgacctgctccagatgatggccaaaaaaggtgctgaccattcccccaacgtggtctcatacaacttggtaatcaatggtttctttaaggagggtgaaataagcaaagcatgtgatctgttccatgaaatgatacaacaagggtttgttcccgatgtggtgacgtataactctgttattaatgcaccgtgcaaagcaagagcaatggacaaggcagaggtggtccttcgatcgatggttcataatagtgtccaaccggatgttgtaacatataatagcttgatccaaggatttttaactacgggtcagctgaaagaagcctttaggttgttgaaagtgatgagaagccaaggtgttatgccaagcgttgttacttgcacctcagtcatggactacctttgcaagcatggaagaatcaaagaagctgaggaaacattttattccatggccgtgagtggccgaaaaccagatacagtctcatactctattatgctccttgggtacgctatagaaggatcccttgttaaaatgattgatctctgtgagatgatggcaagagatggagttgtacccgacctccgttgtttcaacatactgattaaggcatatgctaagtatggcaggatggatgtggccatgcttttctttgaagacatgttgaagcagggtgtgaagcctaatggattcacttatttaattgtgatatctgcattttgcaagatgggcaggatggatgatgcgatggaaaaattcaatgagatgattgatatgggagtaccacttgacacagaagtttacatgtgcatggttgagggttattttaatcatggtgattccatgaaagccgaggaatttattactaaaatgaagaacagggatattcatcataagccatggaaaggtaatcga

SEQ ID NO: 2408 - DNA, 1452 bp, Triticum aestivum; identical to SEQ ID NO: 2406

SEQ ID NO: 2409 - DNA, 1452 bp, Triticum aestivum; identical to SEQ ID NO: 2405

SEQ ID NO: 2410 - DNA, 1452 bp, Triticum aestivum; identical to SEQ ID NO: 2406

SEQ ID NO: 2411 - DNA, 894 bp, Triticum aestivum
atgagccgccgctttccccctggagctatgagcagacgcatcttggagcggaaaattcaagaccggtaccgtgccggacacattggcactgacgacgcactcaacctgttcgacgaattgatccaggttgctgggccttcctcggtccgcgccatcaactgcctcctcaccgttgtcggccgtgattgccccgcgctcggcgtctccctcttcaaccgtgttgcaagagccaaggtgcctccacacaatatcacctatggcattctagtcgactgctgctgccgtgctggccgcttggaccttggacacgctgccatgggacacgtcatcaagttgggatttacagcagaagctattgtcaatttcagccacctactcaaggccatctgtgcagagaagaagaccagttatgcaatggacattgtactccggataatgcccgagtttaactgtgttccgaacattttctcctataacattcttttcaagggtctctgcaatgagaggagaagccaagaggctgttgagctgattaacattatggttgaggatggacgaggttgctgccgacctgatgtggtgacctataacactgtaatcgatggcttgttgaaagagggtgaggtaggcaaggcttacagcctattttgtgaaatgccacagaggggaatttcgccggatgatgtgacctggaactcaatcatctctggcatgtgcaaggttcatgcgatggacaaggctgaggatgttcttgaacagatgcttgatagaggaattctgccagatgttaccacatataatagtctgatacatggatattattcactaggacagtgcgaagaggtggaccggatttcaaggaaatgtctagaaatggtgttcaaccagatattg

SEQ ID NO: 2412 - DNA, 1425 bp, Triticum aestivum
atggccgtctgtgcggagaagaagaccagctatggaatggacatcgtgctccgaattatgcctgagcttaactgcataccggatgtttactcctacagcattcttttcaagggtctctgcaacgagaagagaagccaagaggctctcgagctgattcacatgatggttgagcatggaggtagctgccaacctaatctggtctcatacaacaccgtaattgacggcttgttgaaagagggtgaggtgggcaaggcttacagcctattttgtgaaatggtacagagagggatttcgccaaatattgtgacctacaactcaatcatctctggcatgtgcaaggttcatgcaacggacaaggctgagaaggttcttcaacagatgtttgatagagaatttctgcctgatactgccacatatactagcctaatacatggatattattcatcaggacaatgcaaagaggtggaacaggttttcgagcacatgtctataaatggtgttcaaccaaatatgataacttacaatatacagatggattatcattgcaagagcggaagatgcacggaagctaggaagatctttgattctatggtcagtttgggccaaaaaccgtctgtttctacctacagtattctgcttcatggttatgctattgaaaaatcatttcatgatatgcattgtctccttgatttgatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcgaactatggagcggtaataaacttgctttccagtattggcagaatggatgatgctatgtcccaattcaatcaaatgatagccgaaggattagctcctgatatcatagttttcaacccccttattagtggtttttgtacttgtggcaaatgggagaaggttcatgaactattttctgaaatgttgaatcgcggcatctatcctgataccgtgttcttcaccacaattatggaccgcctttgcaaaaatggaagggttatggaagcccaagatatgtttgacctgatggtacacatgggtgttaagcctaatgttcatgcttatgccacattgatgcatgggtactttttcgttaggaagatggatgaagtgaggaagttacttggcaatatgctctcaattggcttgaaaccggatgttttcatctataccatattgattgatggttactctaagaatggaatgatagataacgcatcagctgttttcactgagatgttggaaaagaatattaagccttctgccatcacttatagcacaatgctctatggcctatttcatgctggactgttgctgccattgaactatatctcagga

SEQ ID NO: 2413 - DNA, 1071 bp, Triticum aestivum
atggactgcagctgccgcgcacaccgcctcgatctggcgtttgccttcttcggccgtctcctcaggacgggactgaaggcaggcgtcatagaagtcaacagtctcctcaaaggactctgccacgcaaagcgggcggatgaggccatggaagtgcttcttcacaggatgcctgagctgtttataggagtacagggcacagctgtttatcgttccctaatccagggattttgtacacacggcgatttggtgaaagcaaaggaatatgttactgaaatgatgaagaaaggtatgcctcctcctgatattatgttcttcagttcaatcatgcagaacctatgcacagaaggaagggtaatagaagcacgagatatccttgacttgatagtgcgcattggtatgaggcctgatgttttcatatttaatatactgatcggtggatactgcctagtcggcaagatggaggatgcctcaaaaatatttgatgatatggtgtcatatggtttagaaccttgtaactttacgtatggtatacttattaatggctattgcaaaaataaaaggattgatgacgggcttattctgttcaaagagatgctgcgcaagggacttaaacctacaacttttaattataacgtcatactggatggattatttctggctggacaaactgttgctgcaaaagagaagtttgatgagatggttgaatctggagtaagtgtgtgcattgatacatactctatagttcttggtggactttgtagaaatagctgcagtagcgaagcgatcaccctgttccgaaaattaagcgcaatgaatgtgaaatttaatattacaattgtcaataccattattggtgccttctacagggtcgagagaaaccaagaggctaaggatttgtttgctgctattccagccagtggcttggttcctaatgttcttacctacaccataatgattaaaaatcttataaaagaaggttcagtggaagaagctaacaatctttttttatcgatggagaagagcggctgtagtgccaactcttatctgttaaatcatatcatcagaaggtgt

SEQ ID NO: 2414 - DNA, 1338 bp, Triticum aestivum
atgctgcgccaacctgtcccaatatcagcgcgtgcactcaacggcttatttgttgcactcgcgcgtgcgccgccctcaaccgcctgcaccaatgcctctgccctcgccatcgatctcttcaaccgcatggcccaagcaggtcgtcgccaggtgacagcgcccaccatttacacctacaatatactaattgactgctgccatcgagcatgctgcccggacctagggcctgccttcttcggccgccgcctcaagacaggcataccgacggacatcattacctacagcaacttattcaagtgcctctgcgacatgaagcgcacggaggaggctttgggcgtgctgctccacaggatgcccgatgacctgcctgatgtcatctcctactcagtaattctcaagagtttatgtgacaatggtaggtgccagctcgcgcttgacctgctccggatgattgccgaaaaaggatctgaccactcccccagcgtggtgtcatacagcatggtaatcgatggtttcttcaaggagggtgaaataagcaaagcatgtgatctgttccatgaaatgatgcagcagggggttgtgcccgatgtggtgacgtatagctctgttatcgatgctctgtgcaaagcaagagcaatggacaaggcagaggtggttcttcgatcaatggttcataatggtgtccaaccagatgctgtgacatataattgcctgatccaaggatattcgactttgggacagttgaaagaagtcgctaggttgttgaaagtgatgagaagccaaggtgttatgccaagcgttgttacctacacctcactcatggactacctttgcaagcatggaagaatcaaagaagctgaggaaatattttattccatggctgtgaatggacgaaaaccagatatagtctcatactctattatgctccgtgggtacgctatagaaggatccctcattgatatgatccatctctgtgagctgatggcaagaaatggagttgtacccgacctctattgtttcaacatactgattaatgcatgtgctaagcatggaatgatggatgtggccctgcttttcttcgaagatatgttgaagcagggggtgaagcctaatgaattcacttatttaactgtgatatctgcattttgcaagatgggcaggatggatgatgcgatggaaaaattccgtgagatgattgatatgggagtaccagttgacacagaagtttacatgtgcatggttgagggttattttaaaaatggtgattcagtgaaagccaaggattttattaccaaaatgaagaacaaggatatttcaaataggccgcagaagggtaat

SEQ ID NO: 2415 - DNA, 1338 bp, Triticum aestivum; identical to SEQ ID NO: 2414

SEQ ID NO: 2416 - DNA, 1338 bp, Triticum aestivum; identical to SEQ ID NO: 2414

SEQ ID NO: 2417 - DNA, 1338 bp, Triticum aestivum; identical to SEQ ID NO: 2414

SEQ ID NO: 2418 - DNA, 1338 bp, Triticum aestivum; identical to SEQ ID NO: 2414

SEQ ID NO: 2419 - DNA, 1338 bp, Triticum aestivum; identical to SEQ ID NO: 2414

SEQ ID NO: 2420 - DNA, 1431 bp, Triticum aestivum
atgtcacgcctccagccccgctcctcacgcgccaacgagctgctagacgaattcaaatatcatctgggctccgggacgctctggccggagctcgcgcaccaactgttcgacgaattgctgcgccaacccgtcccggtttcagcgcgcgcactcaacggcttgtttgctgccctcgcggatgcgccgccctcggccaactgcgcagatggccctgccctagccatcaatctcttcaaccgccaccggatatcacctaacatttacacctacaacatactaattgagtgctgccacagagcatgccgcccagacctagggcctgccttcttcggccgcctcctcaaggcaggcatcacaatgagcgtcattacctacaacagcttattcaagtgcctctgtgacatgaagcgcacggaggaggcttccgacgtgctgctccacaggatgcctgacgacctgcctgatgtcatctcctactcagtaattctcaagagtttctgcgacagtgggaggagccagcgtgcgcttgacctgctccgggtgatggccaaaaaaggtggtgactactctcccaacgtgatttcatacaacatggtaatggatggcttttttaaggagggtgaagtaagcaaagcacgtgttctattccacgaaatgatacaacagggggttgtgcctactgaggtgacatatagctccataatcaatgcgctatgcaaagcaagagcaatggataaggcggaggtgatccttcgacatatggttcgtagtggtgtccaaccacatgataggatatataataccctgatccatggatttttaacttcaggtcagctgaaagaagcctttaggctgttgaaactgatgacaagccaaggtgttatgccaagcgttgttacctacaactcactcatgacctacctttgcaagaatggaagattcaaggaagctgtagaacttttttattcaatggctgtgaagggccaaaaacctagtgtcgtctcatactctataatactccatgggtacgctatagaaggatcccttgttaaaatgattgatctctgtgagctgatggcaagagacggagttgtacctaacctccattgtttcaacatactgattaatgcgtatgctaagtatggcatgatggacgtggccatgcttttcttcgaagacatgttgaagcagggtgtgaagcctaatgaattcacttatttaactgtgatatctgcgttttgcaagatgggcaggatggatgatgcgatggaaaaattcagtgagatgattaatatgggagtaccacttgacacagaagtttacatgtgcatggttgagggttatttgaatcttggcaattccatgaaagccaaggaatttattaccaaaatgaagaacagggatattcatcataggccacggaaaggtaat

SEQ ID NO: 2421 - DNA, 1431 bp, Triticum aestivum; identical to SEQ ID NO: 2420

SEQ ID NO: 2422 - DNA, 1431 bp, Triticum aestivum; identical to SEQ ID NO: 2420

SEQ ID NO: 2423 - DNA, 1431 bp, Triticum aestivum; identical to SEQ ID NO: 2420

SEQ ID NO: 2424 - DNA, 1431 bp, Triticum aestivum; identical to SEQ ID NO: 2420

SEQ ID NO: 2425 - DNA, 1431 bp, Triticum aestivum; identical to SEQ ID NO: 2420

SEQ ID NO: 2426 - DNA, 1212 bp, Triticum aestivum
atggccagagcaggccgccactggatgacagcacccaccattcacacctacaacatactaattgactgctgccaccgagcatgccgcccagacctagggcctgccttcttcagccgcctcctcaagacaggcatcacaatgagcgtcattacctacagcagcttattcaagtgcctctgtgacatgaagcgcacggaggaggctttgggcgtgctgctccacaggatgcccgacgacctgcctgatgtcatctcctactcagtaattctcaagagcttctgcgacagtggtaggagccagcttgcgcttgatctgctccgaatgatggccgaaaaaggatctgaccactcccccagcgtggtgtcatacagtgtggtaatcgatggtttcttcaaggagggtgaaataagcaaagcatgtgatctgttccatgaaatgatgcagcagggggttgtgcccgatgtggtgatgtatacctccattatcaatgcgctatgcaaggcaagagcaatggacaaggcagaggtggttcttcgatcaatggttcataatggtgcccaaccagatgctgtgacatataatagcctgatccaaggatattcaactttgggccagttgaaagatgtcgttaggttgttgaaagtaatgagaagccaaggtgttatgccaagcgttgttacctacacctcactcatggactgcctttgcaagcatggaagaatcaaagaagctgaggaaatattttattccatggctgtgaatggacaaaaaccagatatagtctcatactctattatgctccgtgggtatgctatagaaggatccctcgttgatatgatcgatctctgtgagctgatggcaagaaatggagttgtacccgacctccagtttttcaacatagtgattaatgcatatgctaagcatggaatgatggatgtggccctgcttttcttcgaagatatgttgaagcagggggtgaagcctaatgaattcacttatttaactgtgatatctgcattttgcaagatgggcaggatggatgatgcggtggaaaaattccgtgagatgattgatatgggagtaccagttgacacagaagtttacatgtgcatggttgagggttattttaaaaatggtgattcagtgaaagccaaggattttattaccaaaatgaagaacaaggatattccaaataggccgcagaagggtaat

SEQ ID NO: 2427 - DNA, 1368 bp, Triticum aestivum
atgtgcaaggttcaagcaatggatgaggccgaggaggtccttcaacagatgtttgatacaggtattctgccaaatattactacatataatagtctgatacacggatattattcatcaggacagtgcgaacaggtggctcatattttcaagaaaatgtctaggaatggtgttcagccagatattgcaacttacaccatacagatggattatctttgcaagagtagaagatttgcgggagctagaactatttttgattctatggccggtaaggaccaaaaaccgaatgttactagctacagtattctgcttcatgcatatgctatggaacagtcagtccatgatatgcattgtctcattgaattgatggtagaaaatggtattgcaccaaatcattctgtgtacaacatactgatagttgcatatgctaaggggaaaatgtttgatgaggtaatgcatatatttacaaaaatgcggcagcaaggattgaacccaaatgctgcgagctatggaacagtaataaacttactttgcagtattggccgaatggatgatgctatgttgcaattcaatcaaatgataactgaagaattagctcctgatatcatagttttcaacactcttataagtggtttttgttcttgtggaaaatgggagaaggttcatgaactacttgctgaaatgttgaatcgtggcatctatcccgacaacgtgttcttcaacacaattatggatcacctttgcaaaaatggaagggttatggaatcccaagatctcgctgacctgatgatacacatgggtttgaagcctgacatgcatacttataacacactgatgggtggatactttttcattggtaagatggatgaagtgaggaagttacttgaccatatggtctcaattggcatggaaccagatgttgtcacctataacacactgattgatggttactttaagaatggaatgatagatgatgcgttagctattttcagtgaaatgctggacaaaaaagttaagccttgtgttatcacttataacacagtgttgcatgggttatttcatactggaaggactgttgctgcaaatgaactctatctcaggatgattgacagcggaatatgtgtggatattgtgacctacaacataattctcagtggtttgtgtagaaataactgtgtggatgaagcactaagaatgtttcaaaacctgtgttcaacaaattatcaacttgagatcaggacttataatattatgattagtgcgttgcttaaagttggcaggaaggaagaagccacaggtttgttggatggaatctcggccaaaggatttgtgctcgatgctgttacgtatagattaatgatacaaagcttt

SEQ ID NO: 2428 - DNA, 825 bp, Triticum aestivum
atggatgatgctatgttgcaattcaatcaaatgataactgaagaattagctcctgatatcatagttttcaacactcttataagtggtttttgttcttgtggaaaatgggagaaggttcatgaactacttgctgaaatgttgaatcgtggcatctatcccgacaacgtgttcttcaacacaattatggatcacctttgcaaaaatggaagggttatggaatcccaagatctcgctgacctgatgatacacatgggtttgaagcctgacgtgcatacttataacacactgatgggtggatactttttcattggtaagatggatgaagtgaggaagttacttgaccatatggtctcaattggcatggaactggatgttgtcacctataacacactgattgatggttactttaagaatggaatgatagatgatgcgttagctgttttcagtgaaatgttggacaagaaagttaagccttgcgctatcacttataacacagtgctgcatgggttatttcatactggaaggactgttgctgcaaatgaactctatctcaggatgattgacagcggaatatgtgtggatattgtgacctacaacattattctcagtggtctgtgtagaaataactgtgtggatgaagcactaagaatgtttcaaaacctgtgttcaacaaattatcaacttgagaccaggacttataatattatgattagtgcgttgcttaaagttggcaggaaggaagaagccacaggtttgttggatggaatctcggccaaaggatttgtgcccgatgctgttacgtatagattaatgatacaaagcttt

SEQ ID NO: 2429 - DNA, 825 bp, Triticum aestivum; identical to SEQ ID NO: 2428

SEQ ID NO: 2430 - DNA, 915 bp, Triticum aestivum
atgtttgatacaggtattctgccaaatattactacatataatagtctgatacacggatattattcatcaggacagtgcgaagaggtggctcatattttcaagaaaatgtctaggaatggtgttcagccagatattgcaacttacaccatacagatggattatctttccaagagtagaagatttgcggaagctagaactatttttgattctatggccggtaaggaccaaaaaccgaatgttactagctacagtattctgcttcatgcgtatgctatggaacagtcagtccatgatatgcattgtctcattgaattgatggtagaaaatggtattgcaccaaatcattctgtgtacaacatattgatagttgcatatgctaaggggaaaatgtttgatgaggtaatgcatatatttacaaaaatgcggcagcaaggattgaacccaaatgctgcgagctatggaacagtaataaacttactttgcagtattggccgaatggatgatgctatgttgcaattcaatcaaatgataactgaagaattagctcctgatatcatagttttcaacactcttataagtggtttttgttcttgtggaaaatgggagaaggttcatgaactacttgctgaaatgttgaatcgtggcatctatcccgacaacgtgttcttcaacacaattatggatcacctttgcaaaaatggaagggttatggaatcccaagatctcgctgacctgatgatacacatgggtttgaagcctgacatgcatacttataacacactgatgggtggatactttttcattggtaagatggatgaagtgaggaagttacttgaccatatggtctcaattggcatggaaccagatgttgtcacctataacacactgattgatggttactttaagaatggaatg

SEQ ID NO: 2431 - DNA, 825 bp, Triticum aestivum; identical to SEQ ID NO: 2428

SEQ ID NO: 2432 - DNA, 1368 bp, Triticum aestivum; identical to SEQ ID NO: 2427

SEQ ID NO: 2433 - DNA, 825 bp, Triticum aestivum; identical to SEQ ID NO: 2428

SEQ ID NO: 2434 - DNA, 690 bp, Triticum aestivum
atgttgaatcgtggcatctatcccgacaacgtgttcttcaacacaattatggatcacctttgcaaaaatggaagggttatggaatcccaagatctcgctgacctgatgatacacatgggtttgaagcctgacatgcatacttataacacactgatgggtggatactttttcattggtaagatggatgaagtgaggaagttacttgaccatatggtctcaattggcatggaaccagatgttgtcacctataacacactgattgatggttactttaagaatggaatgatagatgatgcgttagctattttcagtgaaatgctggacaaaaaagttaagccttgtgttatcacttataacacagtgttgcatgggttatttcatactggaaggactgttgctgcaaatgaactctatctcaggatgattgacagcggaatatgtgtggatattgtgacctacaacataattctcagtggtttgtgtagaaataactgtgtggatgaagcactaagaatgtttcaaaacctgtgttcaacaaattatcaacttgagatcaggacttataatattatgattagtgcgttgcttaaagttggcaggaaggaagaagccacaggtttgttggatggaatctcggccaaaggatttgtgctcgatgctgttacgtatagattaatgatacaaagcttt

SEQ ID NO: 2435 - DNA, 1368 bp, Triticum aestivum; identical to SEQ ID NO: 2427

SEQ ID NO: 2436 - DNA, 1368 bp, Triticum aestivum; identical to SEQ ID NO: 2427

SEQ ID NO: 2437 - DNA, 825 bp, Triticum aestivum; identical to SEQ ID NO: 2428

SEQ ID NO: 2438 - DNA, 1368 bp, Triticum aestivum; identical to SEQ ID NO: 2427

SEQ ID NO: 2439 - DNA, 612 bp, Triticum aestivum
atgtgcaaggttcaagcaatggataaggccgaggaggtccttcaacagatgtttgatacaggtattctgccaaatattactacatataatagtctgatacacggatattattcatcaggacagtgcgaagaggtggctcatattttcaagaaaatgtctaggaatggtgttcagccagatattgcaacttacaccatacagatggattatctttccaagagtagaagatttgcggaagctagaactatttttgattctatggccggtaaggaccaaaaaccgaatgttactagctacagtattctgcttcatgcgtatgctatggaacagtcagtccatgatatgcattgtctcattgaattgatggtagaaaatggtattgcaccaaatcattctgtgtacaacatattgatagttgcatatgctaaggggaaaatgtttgatgaggtaatgcatatatttacaaaaatgcggcagcaaggattgaacccaaatgctgcgagctatggaacagtaataaacttactttgcagtattggccgaatggatgatgctatgttgcaattcaatcaaatgataactgaagaattagctcctgattcagcctcattt

SEQ ID NO: 2440 - DNA, 825 bp, Triticum aestivum; identical to SEQ ID NO: 2428

SEQ ID NO: 2441 - DNA, 1077 bp, Triticum aestivum
atgccaaccgcccgcctgtcctccctctccacctcctccttcaaggctccttcacgagagcgccgagcccccctcgccgccttggctgccgccacggagcgcgtccgcgagggaacgctaagtcggcaggacgcgcaccacctgttcgacgaattgctaggccaagccgccgccgtcccggaacgcgggctgaacaactttcttgccgcactagcccgtgctccgccctcatctgcctgcagcgatggccccggccttgccattgccctcttcaaccgcatgtcccaaggcgctggtgcacgggtggtgtcgcccacgctctgtacctattccatcctcatggactgctgctgccgcgcaggccgcccggacttggtggttgccttcttcggtcgcctcatcaggttggggttgcgcttggaggtcatctccttcagcaatctcctcaaggggctttgcaaggccaagcgctcaaatgaggcattggatctgctgctccaccggatgcctgaactggactgtgcgcctgatgtcttctcctacagcattgtaatcaacggctgctttaaagaaggtgaagtagacaaagcgtgcaatctcttccatgagatgatccaactgggagttcaacctaatgtggccatctacacctcaattatcgatgcactaagcaagtgcggagccatggacaaggcagaagtggtccttcggcaaatggttgatcaaggcattggacccaacatcaggacatatactagcctgatacatggatattccgcttcgggtcagtggaaggaggcagttaggttattcaagaaaatgataaggcttggtgctctaccagataccgtcatgtggaactcatttatggattcactttgcaagcatagaaggacaaaggatgctagagatatttttgactccatggctgcaaagggccaaaaacctgatattttctcctattctactatgcttaacgggtatgcgaaagaaggatgcttcgatgatatgacttgtctcttcaattcgatgctacagaatggtattctacctgatcaccgtgttttcaacattgat

SEQ ID NO: 2442 - DNA, 1077 bp, Triticum aestivum; identical to SEQ ID NO: 2441

SEQ ID NO: 2443 - DNA, 1077 bp, Triticum aestivum; identical to SEQ ID NO: 2441

SEQ ID NO: 2444 - DNA, 1077 bp, Triticum aestivum; identical to SEQ ID NO: 2441

SEQ ID NO: 2445 - DNA, 1077 bp, Triticum aestivum; identical to SEQ ID NO: 2441

SEQ ID NO: 2446 - DNA, 1077 bp, Triticum aestivum; identical to SEQ ID NO: 2441

SEQ ID NO: 2447 - DNA, 1341 bp, Triticum aestivum
atgctgcgccaacctgtcacagtatcagtacgtgcactcaacggcttatttgctgctcttgcgcgtgcgccgccctccaccatctgcaccgatgcccttgccctcgccattgatctcttcaaccgcatggcccaagcaggccgtcgccaggtgccagcacccaccattatcacctacaacatactgattggctgctgccaccgagcatgccgcccggacctagggcctgccttcttcggccgcctgctcaaggcaggcatcaagacggatgtcattacctacagcagcttgttcaagtgcctctgtgacatgaagcgcacagaggaggctctgaacatgctgttccataagatgcccgaagacctgcctaatgtcatctcatactcagtgattctcaagagcttctgcgacaatgggaggagccagcttgcgcttgatctgctccagatgatggccaaaaaaggcgctgaccactcccccgacgtgatgtcatacaacatggtaattgatggcttctttaaggagggtgaagtaagcaaagcatgcgatctattccaagaaatgatacgacaggggattgtgcctactgaggtgacatatagctccattatcaatgcgctatgcaaagcaagagcaatggacaaggcagaggtggttcttcgatcaatggttcataatggtgcccaaccagatgctgtgacatataatagcttgatccaaggatattcaactttgggacagttgaaagaagtcgctaggttgttgaaagtgacgagaagccaaggtgttatgccaagcgttgttacctacaactcactcatggactacctttgcaagcatggaagaatcaaagaagctgaggaaatattttattccatggccgtgaatggccgaagaccagatatagtctcatactctattatgctccatgggtacgctatagaaggatcccttgttaaaatgattgatctctgtgagctgatggcaagagatggagttgtacccgacctccgttgtttcaacatactgattaatgcatatgctaagtatggtaggatggatgtggccatgcttttctttgaagacatgttgaagcagggtgtgaagcctaatgaattcacttatttaactgtgatatctgcattttgcaagatgggcaggatggatgatgcgatggaaaaattcagtgagatgattgatatcggagtaccacttgacacagaagtttacatgtgcatggttgagggttattttaatcatggtgattccatgaaagccgaggaatttattaccagaatgaagaacagggatattaatcataagccgtgggaaggtaatcga

SEQ ID NO: 2448 - DNA, 723 bp, Triticum aestivum
atggatcgcctttgcaaaaatggaagggttacggaagcccaggatctctttgacctgatggtacacatgggtgtgaagcctgacgtgtgtacttataacacactgatgggtggatacttgttcgttggtaagatggatgaagtgagcaagttacttgacaatatggtctcaattggcatggaaccagatgttatcacatatagcatactgattgatggttactctaagaatggaaggatagatgatgcattggttgttttcagggaaatgttggacacgaagggtaagccgtctgttatcagttttaatattatgattggtgcattgcttaaatgtggtaggaaggaagaagccaaagatttgtttgatggtatctgggccaatgggttagtgcctgacgttattacatatagcttaatgatacaaaaacttattgaagaaggttctctacaagagtctgatgatctattcctttctacggagaagaatggatgtgctgccgactcccgtaggctaaatgctatagttagaagcttacttcagaaaggggagattcctagggctgggacttatctgtctaaaattgatgagaggggcttcacccttgaagcttccacagctagcttgttgactgcacttgcttcagggggaaaaggccaggaatacaaggagttactccctgaaaaataccactcttttctggaacagggcactttgaacttc

SEQ ID NO: 2449 - DNA, 723 bp, Triticum aestivum; identical to SEQ ID NO: 2448

SEQ ID NO: 2450 - DNA, 1362 bp, Triticum aestivum
atggagcaagcccatccccctaactctgctctcgttatttcctatcccaggctgcgccgatccggtctggtaggtggtgagcggtggcgacgcattataacttacaatatacagatggattatctttgcaagagcggtcaatgtgcagaagctaggaagatttttgattctatgatcagtctgggccaaaacccgactgctactacctacagtattctgcttcatgggtatgctatggaaaaatcttttcatgatatgcattgtcttattgatttgatggtagaaaatggcatttcacctgatcattatgtctacaacatactcatatctgcatacgctaaagaagaaatggttggtgaggtaatgcatatatttacaaaaatgcggcagcaaggattgaaccctgatgcagtgagctacggaacagtaatagacttactttccaggattggccgaatggatgatgctatgtccctattcaatcaaatgataactgaaggattagctcctggtaccatagttttcaaccaccttattagtggtttttgtacttgtggcaaatgggagaaggttcatgaactattttctgaaatgttggatcgcggcatctgtccagacacagtgttcttcaacacagttatggatcgcctttgcaaaaatggaagggttacggaagcccaggatctctttgacctgatggtacacatgggtgtgaagcctgacgtgtgtacttataacacactgatgggtggatacttgttcgttggtaagatggatgaagtgagcaagttacttgacaatatggtctcaattggcatggaaccagatgttatcacatatagcatactgattgatggttactctaagaatggaaggatagatgatgcattggttgttttcagggaaatgttggacacgaagggtaagccgtctgttatcagttttaatattatgattggtgcattgcttaaatgtggtaggaaggaagaagccaaagatttgtttgatggtatctgggccaatgggttagtgcctgacgttattacatatagcttaatgatacaaaaacttattgaagaaggttctctacaagagtctgatgatctattcctttctacggagaagaatggatgtgctgccgactcccgtaggctaaatgctatagttagaagcttacttcagaaaggggagattcctagggctgggacttatctgtctaaaattgatgagaggggcttcacccttgaagcttccacagctagcttgttgactgcacttgcttcagggggaaaaggccaggaatacaaggagttactccctgaaaaataccactcttttctggaacagggcactttgaacttc

SEQ ID NO: 2451 - DNA, 723 bp, Triticum aestivum; identical to SEQ ID NO: 2448

SEQ ID NO: 2452 - DNA, 1371 bp, Triticum aestivum
atgtcaaacattggcatgccaatttttggcagcaaaccaattatgctccatgttccgcatgcgcctccgcaactcctccaccatgcccatgtcccgcatcggcctcctccgccgccgcctctcctcctcctcctcctcctacttctccacctccacctcgccaccctcacggtcacggtcatggtctccccgcgacgcctttgccgcggccacggagcgcgtccgcgccgggacgctcagcccggaggacgcacaccacctgttcgaccaattgctacggcaggacactccggtccacgagcgctccctgggcggcttccttgccgccctcgcccgtgcgccagactcagctgcctgcagagatggccccgccctcgccatcgccctcttcaaccgcgtatgccgaggagaagcaggccggcgggtggtgccgcccacagtctacacctacgccatcctgatgaactgctgctgccgcgtgcgtcgtccggacctagggcttgccttatttggccgcctcctaaggacaggcctcaaaacaaattagatcgtcgccagcaccgtcctcaagtgccttgctgcgcaaaacggacagatgaagcagtaaacgtgctgattcataggatgtccgacctcggctgtgtgccaaatgagttctcatacaacacagttctgaagagcctgtgtgaagatagcaggagccagcgagcgctcgatctgctccgggtgatggcaaaaggagatggctgctccccctgcgtggtgtcatacagcactgtcatctatggcttctttaaggaaggaaaagtaggcaaggcatgcaatctatttcatgaaatgacgcagcaaggcgttgtgtctgatgtggtgacatataactcaattatcgatgcactgtgcaaggccagagctatggacaaggctgagctattccttcggcagatggttgatgatgatattcgaccgaatggagtgacatatactgcaatgatccatggatattccactttgggccagtggaaaaaggcgactcaaatgtttagagaaatgacaagccgcggtcttgtaccagatactgtcacttggaactcattcatggcctccctctgcaagcatggaagaagcagagaagctgcagaacttctttattccatggctgcgaagggccacaagcctaatgtcgtatcctactctactttgcttcatgggtatgcaaacgaagggtgctttgctgatatggttaatctttttaattcaatggtaggcaaaggtattgtaccggaccaccatgttttcaacatattcattaatgcatatgctaaatgtgggatgatggatgaagttatgcatatgttgactgaaatgcaggaa

SEQ ID NO: 2453 - DNA, 1290 bp, Triticum aestivum
atgtctagaaatggtgttcaaccagatattgtaacttataatatacagatggattatctttgcaagaatggaggatgcgcagaagctaggaaattttttgattccatgatcagtttgggccaaaaaccgactgttactacctacaacattctgcttcatgggtatgctatggaaagatcttttcatgatatgaattgtctcattgatttgatggtaggaaatggtattgcaccagatcataatgtctacaacatactcatatctgcatatgctaaagaagaaacggttggtgaggtaatgcatatatttacaaaaatgcggcagcaaggattgaaccctaatgcagcgagctatggaacggtaataaacttactttgcagaattggcagaatggatgatgctgtgttgcaattcactcaaatgataacggaaggattaactcctgatatcatagttttcaccccccttattagtggtttttgtgcgtgtggcaaactggagaaggttcatgaactattttctgagatgttggatcgcggcatctatcctgataccatgttcttcaccacagttatggaccgcctttgcaaaaatggaagggttatggaagcccgagatatctttgatctgatggtacacatgggtgtaaagcctgacgtgcgtagttatgccacactgatgcatggatactttttagttggtaagatggacgaagtgaggaagttacttgacaatatgtgctcaattggcatggaaccagatgttgtcacctatagcatactgattgatggttactctaagaatggaaggatagatgatgcatttgttgttttcaaggaaatgttggaagggaaggttaagccttgtgttatcacttttactattatgattggtgcgttgcttaaatgtggcaggaaggaagaagccaaagatttgtttgatggtatctgggccaatggattagtgcccaatgttattacatatagcttaatgatacaaaaccttatagaagaaggttctctacaagagtctgatgatctcttcctttctatggagaagaatgggtgtgctgctgactcacgtatgctaaatgctatagttagaaggttacttcagagaggggagatgccaagggctgggacttatctgtctaaaattgacgaggggagcttcacccttgaagcttccacagctggcttattgactgcgcttgcttcaggggggaaatgtcaggaatataaggggttactgcctgaaaaatatcactcttttctggaacagggcactgat

SEQ ID NO: 2454 - DNA, 1290 bp, Triticum aestivum; identical to SEQ ID NO: 2453

SEQ ID NO: 2455 - DNA, 1290 bp, Triticum aestivum; identical to SEQ ID NO: 2453

SEQ ID NO: 2456 - DNA, 1326 bp, Triticum aestivum
atgagcggccactttgtccccgtcgacagacgcatcttggagcagaacatcaaggctcggtaccacgccggagacattggcaccgaggatgcactccacctgtttgacgaattgctccagtgtgctgggtcctcctcgatccgtgccatcaactatctcgttactactgtcggccgtgattcccctgcgctcggcgtctccctcttcaaccgcgtcgcaagtgccaatgtggcaccaaacagtatgacgtacaccatcctcgttgactgctgctgccgtgctggccgcttggacctcggtttcgctgccatgggccacatcatcaagatgggatttgcagcagatgctatcgtcactttcagccacctactcaaggccatctgtgcggagaagaagaccagctatgcaatggacatcgtactccgaataatgcccatgtttaactgcgtacccgacaatttctcctacaacattcttttcaagggtctttgcaacgaaaggagaagccaagaggctcttgagctgattcacatgatggtacagcatggaggtagctgccaacctaatgtggtgtcctataacaccgtagttgatggcctgttgaaagagggtgaggtgggcaaagcttacaccctattttctgaaatgctgcgtcaggggatatcaccggatgttgtgacctgtacttccatcatctctggcatgtgcaaggttcatgcaatggacaaggctgaggaggttcttcaacagatgcttgatagaagaattctgccagatgctgccacatataattgtctgatacatggatattatttattaggacagtgcgaagaggtggatcggattttcaaggaaatgtctagaaatggtgttcaaccaaatattgtaacttacaatatacagatggattatctttgcaagagcggaaggtgcgcagaagctaggaaaatatttgattctatgatcggtttgggccaaaaaccggttgttactacctacagtattctactgcatgggtatgctatggaaaaatcttttcatgatatgcattgtctcattgatttgatggtagaaaatggtattgcaccaaatcatcctgtctacaacatactcatatctgcatgtgctcaagaagaaatggttagtgaggtaatgcatatatttacaaaaatgcggcagcaaggattgaaccctaatgtagcgaactatggagtggttgtaaacttgctttccaggattggccgaatggatgatgctatgtccctattcaatcaaatgataactgaaggattagctcctgatatcatagttttcacccccccttat

SEQ ID NO: 2457 - DNA, 1326 bp, Triticum aestivum; identical to SEQ ID NO: 2456

SEQ ID NO: 2458 - DNA, 1326 bp, Triticum aestivum; identical to SEQ ID NO: 2456

SEQ ID NO: 2459 - DNA, 1326 bp, Triticum aestivum; identical to SEQ ID NO: 2456

SEQ ID NO: 2460 - DNA, 1326 bp, Triticum aestivum; identical to SEQ ID NO: 2456

SEQ ID NO: 2461 - DNA, 1326 bp, Triticum aestivum; identical to SEQ ID NO: 2456

SEQ ID NO: 2462 - DNA, 1305 bp, Triticum aestivum
atgtctcgcctccgcctcctccgccgcagctcctcctccaccacactgatacccctcctccggctcctccgccgctgctccacctccacctccacgtcgccgccctcacgctcctggtctccccgagacgcctttgttgcggccatagagcgtgttcgcgccaggacgctcagcccggaagacgctcaccacctgttcgacgatttgctcggtcaggccaccccggtccccgtgcgcaccctgaacggcttctttgccgtcctcgcccgtgccacgtcctctgccgcctgcatccgagatggccccgcccttgccgtcgctctcttcaaccgcgtgtgccaagaagaggccggtccgcgtgtggcgacgcccacagtccacacctatggcatcctcatggactgctgctgccgcgcacgtcgcccggacctagggctcgccttattcggccgcttcctcgggacaggcctgaggacaaacgagatcgtcgccaccaccttcctcaagtgcctctgctgcgcgaaacggacagaagaggttgtgaaagtactgcttcacagaatgcccgagctgggctgtgtgcctaatgccatctcgtactccatagttttgaaaagcttgtgtgaaaatagcatgagtcagcaggcactcgacctgctccagatggtagggaaagaaggaggctgccttcgtgatgtggtggcatataacacaatcatccatggcttctttaaggagtgcggaatagacaaggcatgccatctattccatgaaatgatgcggcaaggggttgtgccgactgtggtgacatacaacacagtaattgatgcgttgtgcaaggccggagaaatggacaaggcagagctagtctttcagcggatggctcgtaatggtgcgcagcccaataaagtgacatgtaatggcagtaaatttagttcactgactgacggatattgctcagtcggcaagatggataaaacattcaaactgcttgatgccatggtatcagatggaattgagcctgatgctgttacttatagtgcacttcttgatggctattttaaaaatggaaggatcgatgatggtttgactctatttagagaaatgtcgtgcaagggagttaaaccaacaactgtgacatatggcatcatactggatggtttatatcgtgctgggagaactgctgctgccaagaaaatgtttgatcagatgatcaaaagtggaataacagtgaccgtttccatatacactactccctcctttccggtttataaggcatatttcaacttttttgtttttccaatt

SEQ ID NO: 2463 - DNA, 1305 bp, Triticum aestivum
atgtctcgcctccgcctcctccgccgcagctcctcctccaccacactgatacccctcctccggctcctccgccgctgctccacctccacctccacgtcgccgccctcacgctcctggtctccccgagacgcctttgttgcggccatagagcgtgttcgcgccaggacgctcagcccggaagacgctcaccacctgttcgacgatttgctcggtcaggccaccccggtccccgtgcgcaccctgaacggcttctttgccgtcctcgcccgtgccacgtcctctgccgcctgcatccgagatggccccgcccttgccgtcgctctcttcaaccgcgtgtgccaagaagaggccggtccgcgtgtggcgacgcccacagtccacacctatggcatcctcatggactgctgctgccgcgcgcgtcgcccggacctagggctcgccttattcggccgcttcctcgggacaggcctgaggacaaacgagatcgtcgccaccaccttcctcaagtgcctctgctgcgcgaaacggacagaagaggttgtgaaagtactgcttcacagaatgcccgagctgggctgtgtgcctaatgccatctcgtactccatagttttgaaaagcttgtgtgaaaatagcatgagtcagcaggcactcgacctgctccagatggtagggaaagaaggaggctgccttcgtgatgtggtggcatataacacaatcatccatggcttctttaaggagtgcggaatagacaaggcatgccatctattccatgaaatgatgcggcaaggggttgtgccgactgtggtgacatacaacacagtaattgatgtgttgtgcaaggccggagaaatggacaaggcagagctagtctttcagcggatggctcgtaatggtgcgcagcccaataaagtgacatgtaatggcagtaaatttagttcactgactgacggatattgctcagtcggcaagatggataaaacattcaaactgcttgatgccatggtatcagctggaattgagcctgatgctgttacttatagtgcacttcttgatggctattttaaaaatggaaggatcgatgatggtttgactctatttagagaaatgccgtgcaagggagttaaaccaacaactgtgacatatggcatcatactggatggtttatatcgtgctgggagaactgctgctgccaagaaaatgtttgatcagatgatcaaaagtggaataacagtgaccgtttccatatacactactccctcctttccggtttataaggcatatttcaacttttttgtttttccaatt

SEQ ID NO: 2464 - DNA, 1308 bp, Triticum aestivum
atggttgatctctataattcaatgtcaagcaatggtattgtacccaatcgccaggttttcaacatattaattgatgcatatgctaagcgtggaatgacggatgaagctatgcttatatttactgaaatgcggggacaaggactgagtccagatgtatgcacctattcaactcttatatctgcacttagcagaacgggtaggctggcggatgccatggatagattcagtcagatgatttctattggcatacaaccagacgcagttgtttatcaagctctaattcagggttattgtacagttggtgatttggtgaaagcaaaggttttggtttctgaaatgatgaacagaggtattcctcctcctgacattgtgttctttaattcaataatgactagtctatgcaaagaaggaagggttacagatgcacacagtatccttgacttcgttatacactttggtgtgaggcctagcatcagtacatttaatttgctgattgacgggtattgcttagttggcaagatgaagaaagctttcggagtacttgataccatggcatcagttggcattgagcctgatgatatttcatatagtgcaatcattaatggctgttttaaaaatggaaggatcgatgatggatttaccatattccgagaaatgctgaagaaagttaaacctacaactgttacatataacatcatactgggtgggttattttgtgctgggaaaacagttgctgcaatgaaaatgttccatgagatgatcgaaagtggaataacagtgagcagttccacatacaggacagtccttggaggactttgcaggaatagttgtgaggacgaagcgatcaccctgttccagaaattaggagcaatgaatgtgaagttggatattgcaatactcaataccatgatcaatgcaatgttcaagcttcagagaagagaagaagctaacgatttgttttctgcagtatcagccagtggattggtacctaatgcttctacctatggtgtaatgataaaaaatcttctaagagaaggatcagtggaaaaagctgaaaatatgttctcattaatggagaagagcggttgtgctccggactctcgtcttataaatgatatcatcagaatattactgaagaaaggtgagattgtcaaggctggaaactatatgtctaaagttgatggcaggagcatctcacttgaagcttcaactacttcgttgatgatacgtctcttttcaagtgaagggaaatatcggggacaaataaatttgctccctgtaaagtaccaatttttcgatggagttagt

SEQ ID NO: 2465 - DNA, 1095 bp, Triticum aestivum
atggatagattcagtcagatgatttctattggcatacaaccagacgcagttgtttatcaagctctaattcagggttattgtacagttggtgatttggtgaaagcaaaggttttggtttctgaaatgatgaacagaggtattcctcctcctgacattgtgttctttaattcaataatgactagtctatgcaaagaaggaagggttacagatacacacagtatccttgacttcgttatacactttggtgtgaggcctagcatcagtacatttaatttgctgattgacgggtattgcttagttggcaagatgaagaaagctttcggagtacttgataccatggcatcagtaggcattgagcctgatgatatttcatatagtgcaatcattaatggctgttttaaaaatggaaggatcgatgatggatttaccatattccgagaaatgctgaagaaagttaaacctacaactgttacatataacatcatactgggtgggttattttgtgctgggaaaacagttgctgcaatgaaaatgttccatgagatgatcgaaagtggaataacagtgagcagttccacatacaggacagtccttggaggactttgcaggaatagttgtgaggacgaagcgatcaccctgttccagaaattaggagcaatgaatgtgaagttggatattgcaatactcaataccatgatcaatgcaatgttcaagcttcagagaagagaagaagctaacgatttgttttctgcagtatcagccagtggattggtacctaatgcttctacctatggtgtaatgataaaaaatcttctaagagaaggatcagtggaaaaagctgaaaatatgttctcattaatggagaagagcggttgtgctccggactctcgtcttataaatgatatcatcagaatattactgaagaaaggtgagattgtcaaggctggaaactatatgtctaaagttgatggcaggagcatctcacttgaagcttcaactacttcgttgatgatacgtctcttttcaagtgaagggaaatatcggggacaaataaatttgctccctgtaaagtaccaatttttcgatggagttagt

SEQ ID NO: 2466 - DNA, 1095 bp, Triticum aestivum; identical to SEQ ID NO: 2465

SEQ ID NO: 2467 - DNA, 1095 bp, Triticum aestivum; identical to SEQ ID NO: 2465

SEQ ID NO: 2468 - DNA, 1095 bp, Triticum aestivum; identical to SEQ ID NO: 2465

SEQ ID NO: 2469 - DNA, 1308 bp, Triticum aestivum; identical to SEQ ID NO: 2464

SEQ ID NO: 2470 - DNA, 1332 bp, Triticum aestivum
atggcccgggccttgccatcgccctcttcaaccgcatgtcccgaggcgctggtgcacgggtggtgtcgctgccgtgcaggccgcccggacttggtggttgccttctttggccgcctcctcagattggggctgtgcttgaatgtcatctccttgagcaacctcctcaaggggctctgccaggtcaagcgtacaaatgaggctgtggacttgctgctccaccggacacctgaactggactgtgtgcctaatgtcttctcgtacagcatcgtaatcaacggctgttttaaacaaggtgaagtagacaaagcgtgcaatctcttccatgggatgatccaactgggagttcaacctaatgtggtcatctacacctcaattatcgatgcactaagcaagtgcggagccatggacaaggcagaagtggtctttcggcaaatggttgataaaggtattggacccgatgtcatgacatgcactagtctgatccatggatattccatttcgggtaggtggaaggcggcagtaagggtattcaaagagatgataagtcttggtgttgtaccagataccgtcatgtggaactcatttgtggattcactttgcaagcatagaaggacaaaggaagctagagttatttttgactccatggctgcaaagggccagaaacctgatactgtctcctactctattatgcttaacgggtatgtgaaagaaggatgctttgatgatatgaccggtctcttcaattcgatgctacagaacggtgttgtacctaaccaccatattttcaacatactgatcaatgcatatgctaaacgtggactgatggatgaggctatgcacatgttcgaagtaatgaggcaacaaggagtaaacccagatgtagttgactatctagtagtaatggattcactttgcaaaatgggtaggatggatgctgctctggacaaatttaatcagatggtcaatcaaggagtttcacctaacaaagctgtttaccaatgcctggttctgggttcttgctctcatggtgattttgtgaaagccaaggaattgatttctgaagcacttaatagaggtctctgttctaacagtgtgttcttctatcctgtaataaacgacctgtgcaaagaaggaaaggtgaaggaggcacaggatatgtttgacttcattgtaggtattggtcagcggcccgatgtgattatgtacaattcactgatggatggatattgccttgttggcaaggtggaggaagcactgagagtacttgatgctatgaagtctgctggcctccaacctgatgctattatgtatggtatacttcttaatgatcac

SEQ ID NO: 2471 - DNA, 1332 bp, Triticum aestivum; identical to SEQ ID NO: 2470

SEQ ID NO: 2472 - DNA, 1332 bp, Triticum aestivum; identical to SEQ ID NO: 2470

SEQ ID NO: 2473 - DNA, 1317 bp, Triticum aestivum
atgatgagtctctttaattcaatggaaggcgatggtattgtagccaactcttatgttttcaacatattaattaatgcatatgctaaaggaggaatgatggatgaagctatgctcatacttactgaaatgcggggacaaggactgagtccggatgtattcacctattcaactctggtatctgcattttgcagaatgggtaggctagctgatgctatggataagttcagtcagatgattggtacgggagtacaaccaaacacagttgtttatcattccctagttcagggcttatgtacacatggtgatttggtgaaagcaaaggagttgatttctgaaatgatgaataaaggtatgattcgtccaaacattgcattcttcaattcaataatggacagtctatgcaatgaaggaagggttgtggatgcacaccatatctttgacttggttacagacataggtgagaaacctgatgtcattacatttagtacgctaattgacggatattgcttagtcggtgagatggagaaagcatgccgagtatttgatgccatggtatcagctggcattgagcctgatgtcattacgtatagtacacttgtcagtgggtattgtaaaagtggaaggatcgatgatgggttgattctgttcagagaaatgttgcataaggaagttaaacctacaactgttacatatggcaccgtactggatgggttatttcgtgcttggagatctgctgctgcaaagaaagtgttccatgagatgatcgaaagtggaataatggtgagcatttctatatataatataattcttggaggactttgtagaaataattgcgcagatgaagcgatcgtcctattccagaaattgtgtgcaatgaatgtgaagttcaatatcacaacactcaatatcatgcttaatgcattctacaaggttcaaagaagagatgaagctagtgatttgttcgctgcattaccagccagtgggttggtgcctaatgcttctacttatggagtaatgattcaaaatcttctaaaagaaggagcggtggaagaagctgacagtatgttctcatcaatggagaagagtggttgtgctcctagctctcgtttttcaaattgtatcatcagaacgttattggaacagggggagatagtcaaggctgggaaatatatgtctaaagttgatgggaagacttttttgcttgaagcttcaactacttcattgctgatgtccctcttttcaaggggaggcaaatatcaggagcacatactcttgctccctgcaaagtatcaatttttcagtggagtgaaccacagt

SEQ ID NO: 2474 - DNA, 1317 bp, Triticum aestivum
atgatgagtctctttaattcaatggaaggcgatggtattgtagccaactcttatgttttcaacatattaattaatgcatatgctaaaggaggaatgatggatgaagctatgctcatacttactgaaatgcagggacaaggactgagtccggatgtattcacctattcaactctagtatctgcattttgcagaatgggtaggctagctgatgctatggataagttcagtcagatgattggtacgggagtacaaccaaacacagttgtttatcattccctagttcagggcttatgtacacatggtgatttggtgaaagcaaaggagttgatttctgaaatgatgaataaaggtatgattcgtccaaacattgcattcttcaattcaataatggacagtctatgcaatgaaggaagggttgtggatgcacaccatatctttgacttggttacagacataggtgagaaacctgatgtcattacatttagtacgctaattgacggatattgcttagtcggtgagatggagaaagcatgtggagtatttgatgccgtggtatcggctggcattgagcctgatgtcattacgtatagtacacttgtcagtgggtattgtaaaagtggaaggatcgatgatgggttgattctgttcagagaaatgttgcataaggaagttaaacctacaactgttacatatggcaccgtactggatgggttatttcgtgcttggagatctgctgctgcaaagaaagtgttccatgagatgatcgaaagtggaataatggtgagcatttctatatataatataattcttggaggactttgtagaaataattgcgcagatgaagcgatcgtcctattccagaaattgtgtgcaatgaatgtgaagttcaatatcacaacactcaatatcatgcttaatgcattctacaaggttcaaagaagagatgaagctagtgatttgttggctgcattaccagccagtgggttggtgcctaatgcttctacttatggagtaatgattcaaaatcttctaaaagaaggagcggtggaagaagctgacagtatgttctcatcaatggagaagagtggttgtgctcctagctctcgtttttcaaattgtatcatcagaacgttattggaacagggggagatagtcaaggctgggaaatatatgtctaaagttgatgggaagactattttgcttgaagcttcaactacttcattgctgatgtccctcttttcaaggggaggcaaatatcaggagcacatactcttgctccctgcaaagtatcaatttttcagtggagtgaaccacagt

SEQ ID NO: 2475 - DNA, 1317 bp, Triticum aestivum; identical to SEQ ID NO: 2473

SEQ ID NO: 2476 - DNA, 1317 bp, Triticum aestivum; identical to SEQ ID NO: 2474

SEQ ID NO: 2477 - DNA, 1152 bp, Triticum aestivum
  misc_feature (1111)..(1111): n is a, c, g, or t
  misc_feature (1113)..(1113): n is a, c, g, or t
  misc_feature (1118)..(1118): n is a, c, g, or t
atgatgagtctctttaattcaatggaaggcgatggtattgtagccaactcttatgttttcaacatattaattaatgcatatgctaaaggaggaatgatggatgaagctatgctcatacttactgaaatgcggggacaaggactgagtccggatgtattcacctattcaactctggtatctgcattttgcagaatgggtaggctagctgatgctatggataagttcagtcagatgattggtacgggagtacaaccaaacacagttgtttatcattccctagttcagggcttatgtacacatggtgatttggtgaaagcaaaggagttgatttctgaaatgatgaataaaggtatgattcgtccaaacattgcattcttcaattcaataatggacagtctatgcaatgaaggaagggttgtggatgcacaccatatctttgacttggttacagacataggtgagaaacctgatgtcattacatttagtacgctaattgacggatattgcttagtcggtgagatggagaaagcatgccgagtatttgatgccatggtatcagctggcattgagcctgatgtcattacgtatagtacacttgtcagtgggtattgtaaaagtggaaggatcgatgatgggttgattctgttcagagaaatgttgcataaggaagttaaacctacaactgttacatatggcaccgtactggatgggttatttcgtgcttggagatctgctgctgcaaagaaagtgttccatgagatgatcgaaagtggaataatggtgagcatttctatatataatataattcttggaggactttgtagaaataattgcgcagatgaagcgatcgtcctattccagaaattgtgtgcaatgaatgtgaagttcaatatcacaacactcaatatcatgcttaatgcattctacaaggttcaaagaagagatgaagctagtgatttgttcgctgcattaccagccagtgggttggtgcctaatgcttctacttatggagtaatgattcaaaatcttctaaaagaaggagcggtggaagaagctgacartatgttctcatcaatggagaagagtggttgtgctcctagctctcgtcttntnaatgntgtatcatcagaactttattggaaaagggggaga

SEQ ID NO: 2478 - DNA, 1317 bp, Triticum aestivum; identical to SEQ ID NO: 2473

SEQ ID NO: 2479 - DNA, 1317 bp, Triticum aestivum; identical to SEQ ID NO: 2474

SEQ ID NO: 2480 - DNA, 1080 bp, Triticum aestivum
atggactgctgctgccgcgcagaccgcccggacttggtggttgccttcttcggccgcctcctcaggttggggctgcgcttgaatgtcatctccttcaacaacctcctcaaggggctttgccaggctaagcgctcaaatgaggcattggatctgctgctccaccggatgcccgaactggactgtgcgcctgatgtcttctcgttcaacatagtaatcaacggctgctttagagaaggtgaagtagacaaagcatgcaatctcttccatgagatgccccaactgggagttcaacctgatgtggtgacctacaactcaattatcatcgcactaagcagggccggagcaatgggtaaggcagaagtggtccttcggcaaatggttgataaaggcattggaccagatgtcatgacatataacagtctgatccatggatattctactttgggtcagtggaaggcagcagttagggtattcaaagagatggtaagtgttggtgttctaccaaatgctgtcacgttgaactcatttatggattcactttgcaagcatagaaggacaaaggaagctagagatatttttgactccatggctgcaaagggccacaaacctaatattgcctcctactctactatgcttaatgggtatgcgaaacaaggatgcttcgatgatatgactggtctcttcaattccatggtacagaatggtgttgtaccaaaccaccatattttcaacatactgatcaatgcatatgctaaacgtggactgatggatgaggctatgcacatgttcgaagtaatgaggcaacaaggagtaaacccagatgtatttagccatcaaattgtaatggattcactttgtaaaatgggtaggatggatgctgctctggacaaatttaatcagatggtcaatcaaggagtttcacctaacaaagctgtttaccaatgcctggttctgggttcttgttctcatggtcattttgtgaaagccaaggaattgatttctgaagcagttaatagaggtctgtgttctaacagtgtgttcttctatcctgtagtaaacgacctgtgcaaagaaggaagg

SEQ ID NO: 2481 - DNA, 1290 bp, Triticum aestivum
atgtctagaaatggtgttcaaccagatattgtaacttacagtatacagatggattatctttgcaagagcggaagatgcacagaagctaggaagatttttgattctatgatcagtttgggccaaaaaccgaccgttactacctacaacattctgcttcatgggtatgctatggaaagatctttttatgatatgaattgtctcattgagttgatggatgataatggtatttcaccagatcattatggctacaacatactcatatctgcttatgctaaagaagaaacggttggtgaggtaatgcatatatttacaaaaatgcggcagcaaggattgaaccctaatgttgtgaactatggagcggtaataaatttgctttctagtattggccgaatggatgatgctatgtcccaattcaatcaaatgataactgaagggttagctcctgatatcatagttttcaccccccttattagtggtttctgttcttgtggcaaatgggagaaggttcatgaactattttctgagatgttggatcgcggcatctatcctaataccgtgttcttcaccacagttatggaccgcctttgcaaaaatggaagggctatggaagcccgagatatctttgatctgatggtacacatgggtgtaaagcctgacgtgcgtagttatgccacactgatgcatggatactttttagttggtaagatggatgaagtgaggaagttacttgacaatatgtgctcaattggcatggaaccagatgttgtcacctatagcatactgattgatggttactctaagaatggaaggatagatgatgcatttgttgttttcaaggaattgttggaagggaaggttaagccttgtgttatcacttttaatattatgattggtgcattgcttaaatgtggcgggaaggcagaagccaaagatttgtttgacggtatctgggccaacggattagtgcccgacgttattacatatagcttaatgatacaaaaacttattgaagaaggttctctacaagagtctgatgatctcttcctttctatggagaagaatgggtgtgctgctgactcacgtatgctaaatgctatagttagaaggttacttcagagaggggagatgccaagggctgggacttatctgtctaaaattgacgaggggagcttcacccttgaagcttccacagctggcttattgactgcgcttgcttcaggggggaaatgtcaggaatataaggggttactgcctgaaaaatatcactcttttctggaacagggcactggt

SEQ ID NO: 2482 - DNA, 663 bp, Triticum aestivum
atgttgcgcaagggacttaaacctacaacttttaattacaacgtcatactggatggattatttctggctggacgaactgttgctgcaaaggaaaagtttgatgagatggttgaatctggagtaagtgtgtgcattgatacatattcgatagttcttggtggactttgtagaaataattgtagcggcgaagcaatcacgctattccagaaattaagcacaatggatgtgaaattcaatattataattgtcaatataatgattgatgccttctacagggttcagcgaaaccaagaagccaaggatttgtttgctgcagtatcagccaatggtttggtagctaatgtctttacctacaccataatgatgaaaaatcttataaaagaagggtcagtggaagaagctgacgatctctttttatcaatggagaagagcggctgtactgctgactcttatatgttaaatcttattgtcagaatgttactggaaaaaggagagctagtcaaggctgggaattatatgtctaaagttgatgcaaagagctactcacttgaagctgaaaccgtttcgctgcttatctctctcttttcagggaaagggaaatatagagaacacataggattgctccctacaaagtatcggtttcgtgaagaagcagccacagtt

SEQ ID NO: 2483 - DNA, 1296 bp, Triticum aestivum
atggctatcaagggcctgaaacctgacaacgtttcatatgctattcgccttcatgggtatgccaccgaaggatgcttcgttgatatgattaatctcttcaattcaatggaaagagactgcattcttcctgactgtcgtatcttcagcatactaatttatgcatatgctaaatctgggaagcttgataaggctatgctcatcttcaatgaaatgcagaaacaaggagtgagtccaaatgcagtcacatattcaaccgtaatagatgcattttgcaaaaagggtaggttggatgatgctgtgataaagtttaatcagatgattgatacaggagtacgaccggacacggctgtttatagttccctaatccagggattttgtacacgtggagatttggtgaaagcaaaggaattgcttactaaaatgatgaacaaaggtatacctccttctgatattaagttcttcagttcaatcatgcagaacctatgcacagaaggaagggtaacagaagcacgggatgtccttggcttgatagcgcacataggtatgaggcctaatgtttgcacatttaatatactgatcggtggatactgcctagtcggcaagatggaggatgcctcaaaaatatttgatgacatgatgtcatatggcttagaaccttctaatattacgtatggtatacttattaatggctattgcaaaaacttaaggattgacgatgggctgattctgttcaaagaaatgttgcgcaagggacttaaacctacaacttttaattacaacgtcatactggatggattatttctggctggacgaactgtttctgcaaaggaaaagtttgatgagatggttgaatctggagtaagtgtgtgcattgatacatattcgatagttcttggtggactttgtagaaataattgtagcggcgaagcaatcacgctattccagaaattaagcacaatggatgtgaaattcaatattacaattgtcaatataatgattgatgccttctacagggttcagcgaaaccaagaagccaaggatttgtttgctgcagtatcagccaatggtttggtagctaatgtctttacctacaccataatgatgaaaaatcttataaaagaagggtcagtggaagaagctgacgatctctttttatcaatggagaagagcggctgtactgctgactcttatatgttaaatcttatcgtcagaatgttactggaaaaaggagagctagtcaaggctgggaattatatgtctaaagttgatgcaaagagctactcacttgaagctaca

SEQ ID NO: 2484 - DNA, 1296 bp, Triticum aestivum; identical to SEQ ID NO: 2483

SEQ ID NO: 2485 - DNA, 663 bp, Triticum aestivum
atgttgcacaagggacttaaacctacaacttttaattacaacgtcatactggatggattatttctggctggacgaactgttgctgcaaaggaaaagtttgatgagatggttgaatctggagtaagtgtgtgcattgatacatattcgatagttcttggtggactttgtagaaataattgtagcggcgaagcaatcacgctattccagaaattaagcacaatggatgtgaaattcaatattataattgtcaatataatgattgatgccttctacagggttcagcgaaaccaagaagccaaggatttgtttgctgcagtatcagccaatggtttggtagctaatgtctttacctacaccataatgatgaaaaatcttataaaagaagggtcagtggaagaagctgacgatccctttttatcaatggagaagagcggctgtactgctgactcttatatgttaaatcttattgtcagaatgttactggaaaaaggagagctagtcaaggctgggaattatatgtctaaagttgatgcaaagagctactcacttgaagctgaaaccgtttcgctgcttatctctctcttttcagggaaagggaaatatagagaacacataggattgctccctacaaagtatcggtttcgtgaagaagcagccacagtt

SEQ ID NO: 2486 - DNA, 663 bp, Triticum aestivum; identical to SEQ ID NO: 2482

SEQ ID NO: 2487 - DNA, 1296 bp, Triticum aestivum; identical to SEQ ID NO: 2483

SEQ ID NO: 2488 - DNA, 1296 bp, Triticum aestivum; identical to SEQ ID NO: 2483

SEQ ID NO: 2489 - DNA, 663 bp, Triticum aestivum; identical to SEQ ID NO: 2482

SEQ ID NO: 2490 - DNA, 663 bp, Triticum aestivum; identical to SEQ ID NO: 2482

SEQ ID NO: 2491 - DNA, 663 bp, Triticum aestivum; identical to SEQ ID NO: 2482

SEQ ID NO: 2492 - DNA, 1317 bp, Triticum aestivum
atgccaaccgcccgcctgtcctccatctccacctcctccttcagggctccttcacgtaaaccacgagcccccctcgccgccttggctgccgccacggaacgcgttcgcgctggaacgctaagccgggaggacgcacaccacctgttcgacgaattgcaaggccaagccgccgccgtcccggaacgcgggctcaacaactttcttgccgcactagcccgtgctccgccctcatctgcctgcagcgatggtccgggccttgcctttgccctcttcaaccgcatgtcccgaggcgctggtgcacgggtggtgtcgcctacgctctgtacctattccatcctcatggactgctgctgccgcgcaggccgcccggacttggtggttgccttcttcggccgcctcctcaggttggggctgcgcttgaatgtcatctccttcaacaacctcctcaaggggctctgccaggccaagcgttcaaatgaggctttggacatgctgctccaccggatgcccgaacaggactgtgcgcctgatgtcttctcgttcaacatagtaatcaacggctgctttagagaaggtgaagtagacaaagcatgcaatctcttccatgagatgccccaactgggagttcaacctgatgtggtgacctacaactcaattatcatcgcactaagcagggccggggcaatgggtaaggcagaagtggtccttcggcaaatggttgataaaggcattggacccgatgtcatgacatataacagtctgatccatggatattctactttgggtcagtggaaggcagcagttagggtattcaaagagatggtaagtgttggtgttctaccaaatgctgtcacgttgaactcatttatggattcactttgcaagcatagaaggacaaaggaagctagagatatttttgactccatggctgcaaagggccacaaacctaatattgcctcctactctactatgcttaatgggtatgcgaaacaaggatgcttcgatgatatgactggtctcttcaattcgatgctacagaatggtgttgtaccaaaccaccatattttcaacatactgatcaatgcatatgctaaacgtggactgatggatgaggctatgcacatgttcgaagtaatgaggcaacaaggagtaaacccagatgtatttagctatcaaattgtaatggattcactttgtaaatgggtaggatggatgctgctctggacaaatttaatcagatggtcaatcaaggagtttcacctaacaaagctgtttaccaatgcctggttctgggttcttgttctcatggtcattttg

SEQ ID NO: 2493 - DNA, 1293 bp, Triticum aestivum
atgccaaccgcccgcctgtcctccatctccacctcctccttcagggctccttcacgtaaaccacgagcccccctcgccgccttggctgccgccacggaacgcgttcgcgctggaacgctaagccgggaggacgcacaccacctgttcgacgaattgcaaggccaagccgccgccgtcccggaacgcgggctcaacaactttcttgccgcactagcccgtgctccgccctcatctgcctgcagcgatggtccgggccttgcctttgccctcttcaaccgcatgtcccgaggcgctggtgcacgggtggtgtcgcctacgctctgtacctattccatcctcatggactgctgctgccgcgcaggccgcccggacttggtggttgccttcttcggccgcctcctcaggttggggctgcgcttgaatgtcatctccttcaacaacctcctcaaggggctctgccaggccaagcgttcaaatgaggctttggacatgctgctccaccggatgcccgaactggactgtgcgcctgatgtcttctcgttcaacatagtaatcaacggctgctttagagaaggtgaagtagacaaagcatgcaatctcttccatgagatgccccaactgggagttcaacctgatgtggtgacctacaactcaattatcatcgcactaagcagggccggggcaatgggtaaggcagaagtggtccttcggcaaatggttgataaaggcattggacccgatgtcatgacatataacagtctgatccatggatattctactttgggtcagtggaaggcagcagttagggtattcaaagagatggtaagtgttggtgttctaccaaatgctgtcacgttgaactcatttatggattcactttgcaagcatagaaggacaaaggaagctagagatatttttgactccatggctgcaaagggccacaaacctaatattgcctcctactctactatgcttaatgggtatgcgaaacaaggatgcttcgatgatatgactggtctcttcaattcgatgctacagaatggtgttgtaccaaaccaccatattttcaacatactgatcaatgcatatgctaaacgtggactgatggatgaggctatgcacatgttcgaagtaatgaagcaacaaggagtaaacccagatgtagttractatctagtagtaatggattcactttgcaaaatgggtaagatggctgctgctatggataaatttaatcagatgatcaatcaaggagtttcacctaacaaagctgtttaccaatgcctgggaaaa

SEQ ID NO: 2494 - DNA, 1236 bp, Triticum aestivum
atgagccgccgcatggtccgacgcgtcttggagcggaacatcgaggagcggtaccgcgcggggcacattggcaccgaggacgcactccacctgttcgacgaattgctccaggttgccgggccctcctcgacccgcgccatcaactgcctcctctacgttgtcggccgtgattgccctgctctcggcgtctccctcttcaaccgggtcgcaagagccaaggtgcccccacacaatgtcacctacagcatcctcatcggctgctgctgccatgcgggccggttagacctcggtttcgccgccatgggcaacatcattaagctgggttttgcggctgaagccatgttcagtttcagccacctactcagggccgtctgcgcggagaacaagaccagctatgcaatggacatcgcactccggcgaatgcccgagtttaactgcacaccgaatgttttctcctatagcattcttctcaaaggtctctgtgttgagaagagaagtcaagaggctcttgagcttattcacatgatggtcgatgctggaggtagctgccaacctaatgtggtgtcctatagcactgtagttgatggcctgttgaaagagggtgaggtgaacaaagcttacagcttactttgtgaaatgctacatcaggggatttcaccgaatgttgtgacgtatagctcaatcatctttagcatgtgcaaggttcaagcaatggataaggccgaggaggtccttcaacagatgtttgatacaggtattctgccaaatattactacatataatagtctgatacacggatattattcatcaggacagtgcgaagaggtggttcgtattttcaagaaaatgtctaggaatggtgttcagccagatattgcaacttacaacatacagatggattatctttgcaagagtagaagatttgcggaagctagaactatttttgattctatggccggtaaggaccaaaaaccgaatgttactagctgcagtattctgcttcatgcgtatgctatggaacagtcattccatgatatgcattgtctcattgaattgatggtagaaaatggtattgcaccagatcattctgtgtacaacatactgatagttgtatatgctaaggggaaaatggttgatgaggtaatgcatatatttacaaaaatgcggcagcaaggattgaacccaaatgctgcgaactatggaacagtaataaacttacagtattggccgaatgga

SEQ ID NO: 2495 - DNA, 1236 bp, Triticum aestivum; identical to SEQ ID NO: 2494

SEQ ID NO: 2496 - DNA, 1236 bp, Triticum aestivum; identical to SEQ ID NO: 2494

SEQ ID NO: 2497 - DNA, 1236 bp, Triticum aestivum; identical to SEQ ID NO: 2494

SEQ ID NO: 2498 - DNA, 1236 bp, Triticum aestivum; identical to SEQ ID NO: 2494

SEQ ID NO: 2499 - DNA, 1236 bp, Triticum aestivum; identical to SEQ ID NO: 2494

SEQ ID NO: 2500 - DNA, 1275 bp, Triticum aestivum
atgtccaacctccgcctcctccgccgcagctcctcctccatgtccaccaccacgtcgccgccctcgcgctcctggtccccccattcggcctttgccgcggccacagagcgcgtgcgcgccgggacgctcagccaagacgatgcacaccacctgttcgacgaattgctgcggcaggccaccccggtccacgagcgctccctcaacggcttcctcgccgccctcgcgcgtgctacgtcctctgccgcttgcatcagagatggtcccgccctcgccatcgccctcttcaatcgcgtgtgccgagaacaagccggcccgcgggtggcgcctctcacagtccacacctacggcatcctcatggaatgttgttgtcgggcgggtcacccggaattagggcttgccatattcagccgtcttctcaggacggggctcaagacaaacgagatagtcggcagcaccttcctcaagtgcctctcctacacaaaacggacggatgaggctctgaacgtgttgcttcataggatgcccgagctcggctgtgtgcctaatgccttctcatactccattgttctgaagagcttatgcgacaatagcatgagtcagcgggcgcttgacctgctccagaggatggcgaaagaaggaggtggctgcttccttaatgtggtgacatatagcacggtcatccatggcttctttaaggaaggtgaaataggcaaggcatgcagtctgttccatgaaatgatgcagcaagggattgagcccgatgtgtggacgtataactcgattattgatgcattgtgcaaggccagagcaatggacaaggcagagctagtccttcgtcagatggttgctaaaggtgctcaacccgatacagtgacatataattgcatgatcaatggatatgccacatctgggcggttgaaagaggctgctaaaatgttcagagaaatgaaaagccggggtgttacaccaaatattgttacctgcggctcgttaatgacttccctttgcaagcatggaagaagcaaagaagctagacaaatatttgattccatgactgccaaaggccacagagctaatgtcgtctcatactctattttgcttcatgggtatgccaatgaaggatgctttgctgatatgattgatctctttaattcaatgaaaagcaacggtattgcagccgactgccatgttttcaacatattaattaatggatatgctaaacgtggaatgatggatgaagctgtgctgatattactgaaatgcgggaaaaaggag

SEQ ID NO: 2501 - DNA, 1275 bp, Triticum aestivum; identical to SEQ ID NO: 2500

SEQ ID NO: 2502 - DNA, 1275 bp, Triticum aestivum; identical to SEQ ID NO: 2500

SEQ ID NO: 2503 - DNA, 1275 bp, Triticum aestivum; identical to SEQ ID NO: 2500

SEQ ID NO: 2504 - DNA, 1275 bp, Triticum aestivum; identical to SEQ ID NO: 2500

SEQ ID NO: 2505 - DNA, 1275 bp, Triticum aestivum; identical to SEQ ID NO: 2500

SEQ ID NO: 2506 - DNA, 1287 bp, Triticum aestivum
atggaacatgcctcaaaaatatttgatgatatgatgtcacatggcttagaaccttctaatattacgtatggtatacttattaatggctattgcaaaaatagaaggattgatgacgggcttattctgttcaaagagatgctgcacaagggacttaaacctacaacttttaattatagcttggacattgctatggacaaatttaaccagatggttgatatgggagtacgaccgaatgcaattgtttatcattccctaatccagggtttttgtacacatggggatttagtgaaagcaaaggaattggttgctgaaatgaggaacaaagctatgcgtcctcctgatattaagttcttccattcaataatgcagaacctatgcacggaaggaagggtaatagaagcacgagatatcctcgacttgatagtgcgcattggtatgaggcctgatgttcccatctttaatttactgatcggtggatactgcctagtccgcaagatggcagatgcatcaaaaatatttgatgatatggtgtcatatggtttagaaccttcaaatattacgtatggtatacttattaatggctattgcaaaaatagaaggattgatgaggggctgattctgttcaaagaaatgttgtgcaagggacttaaacctacaacttttaactataacgtcatactggatggattatttctggctggacgaactgttgctgcaaaggaaaagtttgatgagatggttgaatctggagtaagtgtgtgcattggtacatattcgatagttcttggtggactttgtagaaataattgtagcggcgaagcaatcacgctattccagaaattaagcacaatggatgtgaaattcaatattataattgtcattgatgctttctacaaggttcagcgaaaccaagaagccaaggatttgtttgctgcagtatcagccaatggtttggtagctaatgtctttacctacaccataatgatgaaaaatcttataaaagaagggtcagtggaagaagctgacgatctctttttatcaatggagaagagcagctgtactgctgactcttatatgttaaatcttatcgtcagaatgttactgggaaaaggagagatagtcaaggctgggaattatatatctaaaattgatgcaaagagctactcacttgaagctaaaactgtttcgctgcttatctctctcttttcagggaaagggaaatatagagaacacataggattgctccctgcaaagtatcggtttcgtgaagaagcagctacagttgtg

SEQ ID NO: 2507 - DNA, 1089 bp, Triticum aestivum
atgtcccgcctccgcccccgccgctcctccaccacgcccatgttccacctcctccgccgtagctcctcctctacctccacctccacccccaccttgcggccctcgcgttcctggtctccccacgccgcctttgccgccgccacggagcgcgtccgcgccgggacgctcagccctgaagacgcgcaccacctgttcgacgaattgctacggcaggccaccccggtccccagccgctccctggacggtttcattgccgccctcgcccgtgcgcccgcctccgccgcctgcatcagagatggtcccgccctcgcccttggcctcttcaaccgcgtctgccgtgatgaagccggcgcgcgggtggcaccacgcacaatcttcacttacggcatcctcatgaactgctgctgctgcgcacatcgcccggacctagggcttgccttattcggccgcttcctcaggacgggcatgaaggcaaatgaaatcattgccaccaccttcctcaagtgcctctgctccgccaaacgtacagatgaggctgtcaacttgctgcttcataggattcccgagcttggctgcgtgcgtaatgccttctcatactccattgttctgaagagcttttgcgagaatagcatgagtcagcgggggctcgacctgctccagatgatggcgaaagaaggaggcgcctgctcccccaacgtggtggcatatagcacggtcatccatggcttctttaaggaaggcgaaacaggcaaggcatgcaatctattccatgaaatgatgcagcaaggtgttgtgcccactgtggcgacatataactcgattattgatgcgttgtgcaaggccagagcaatggacaaggcagagatagtccttcggcagatggttgataatggtgctcaaccggataattggacatataattgcatgatccatggatattcgacatcagggcagttgagagaggctactaaaatgttaagaaaaatgacaacccggggtcttataccagatattgttacttgcagctcgctcatggcttccctttgcaagcatggaagaagcaaagaagcgtcagacttttttgttcca

SEQ ID NO: 2508 - DNA, 1089 bp, Triticum aestivum
atgtcccgcctccgcccccgccgctcctccaccacgcccatgttccacctcctccgccgtagctcctcctctacctccacctccacccccaccttgcggccctcgcgttcctggtctccccacgccgcctttgccgccgccacggagcgcgtccgcgccaggacgctcagccctgaagacgcgcaccacctgttcgacgaattgctacggcaggccaccccggtccccagccgctccctggacggtttcattgccgccctcgcccgtgcgcccgcctccgccgcctgcatcagagatggtcccgccctcgcccttggcctcttcaaccgcgtctgccgtgatgaagccggcgcgcgggtggcaccacccacaatcttcacttacggcatcctcatgaactgctgctgctgcgcacatcgcccggacctagggcttgccttattcggccgcttcctcaggacgggcatgaaggcaaatgaaatcattgccaccaccttcctcaagtgcctctgctccgccaaacgtacagatgaggctgtcaacttgctgcttcataggattcccgagcttggctgcgtgcgtaatgccttctcatactccattgttctgaagagcttttgcgagaatagcatgagtcagcgggggctcgacctgctccagatgatggcgaaagaaggaggcgcctgctcccccaacgtggtggcatatagcacggtcatccatggcttctttaaggaaggcgaaacaggcaaggcatgcaatctattccatgaaatgatgcagcaaggtgttgtgcccactgtggcgacatataactcgattattgatgcgttgtgcaaggccagagcaatggacaaggcagagatagtccttcggcagatggttgataatggtgctcaaccggataattggacatataattgcatgatccatggatattcgacatcagggcagttgagagaggctactaaaatgttaagaaaaatgacaacccggggtcttataccagatattgttacttgcagctcgctcatggcttccctttgcaagcatggaagaagcaaagaagcgtcagacttttttgttcca

SEQ ID NO: 2509 - DNA, 1089 bp, Triticum aestivum; identical to SEQ ID NO: 2507

SEQ ID NO: 2510 - DNA, 1089 bp, Triticum aestivum; identical to SEQ ID NO: 2507

SEQ ID NO: 2511 - DNA, 1089 bp, Triticum aestivum; identical to SEQ ID NO: 2507

SEQ ID NO: 2512 - DNA, 1089 bp, Triticum aestivum; identical to SEQ ID NO: 2508

SEQ ID NO: 2513 - DNA, 1299 bp, Triticum aestivum
atgtcacgccttcaggtccgctctttctccagccccgtttcctcacgcgccaacgatctgctgaccgaactccacggccatctgggcttcgggacgctcaggccagagctcgcgcaccaactgttcgacgaaatgctgcgccaacctgtcccagtatcagcgcgtgcactcaacggcttatttgctgccctcgcatgtgcgccgccctccgccgcctgcaccgacggccctgtcctcgccatccatcttttcaaccgcatggcccgagcaggctgccgcagggtgatagcactcaccagtcacacctacagcatactaattgaatgttgctgccgcgcgcgccgtccggacctagggccttccttcttcactcaccttctcaagacaggcgtcacggcagacatcgtaatctatagtggcttattcaagtgcctctgcgacttgaagtgcacagaggaggctttggatatgctgctccacagaatgccgaacgacgtaagtgatgccatctcctactcagtaattctcaagagtctttgcgacaacgggaggagccagcttgcgcttgacgtgctccatataatgaccaaaaaaggtgctgactactccccggatgtgtttgcatacaacatggtaatcgatggcttctttaaggaaggtgaagtaagcaaagcatgcgatctgttccatgaaatgatacaacagggggttgtgcccgatgtggcgatgtatacctccattatcaatgcgctatgcaaagcaagagcaatggacaaggcagaggtggttcttcaatcaatggttcataatggtgtccaaccagatgttgtgacatatactatcctgatccaaggatattcaactttgagacagttgaaagaagtcgctaggttgttgaaagtgatgagaagccaaggtgttatgccaagcgttgttacctacaactcactcatgacctgcctttgcaagaatggaagattcaaggaagctgtagaaattttttattcaatggctgtgaagggcctaaaacctaatgtcatctcatactctataatactccatggatacgctaaagaaggatcccttgttgccatgattgatctctatcagttgatggcagcagaaggggtcatacctgacctccattgtttcaacatactaattgctgcatatgctgaatatggaatgatggatgtggctatgcttttcttcgaagacatgttgaagcagggggtgaaccctaatgaagtcacaaattttgtctgtgatagctggattatgcaaaatgggcaggatgga

SEQ ID NO: 2514 - DNA, 1299 bp, Triticum aestivum
atgtcacgccttcaggtccgctctttctccagccccgtttcctcacgcgccaacgatctgctgaccgaactccacggccatctgggcttcgggacgctcaggccagagctcgcgcaccaactgttcgacgaaatgctgcgccaacctgtcccagtatcagcgcgtgcactcaacggcttatttgctgccctcgcatgtgcgccgccctccgccgcctgcaccgacggccctgtcctcgccatccatcttttcaaccgcatggcccgagcaggctgccgcagggtgataccactcaccagtcacacctacagcatactaattgaatgttgctgccgcgcgcgccgtccggacctagggccttccttcttcactcaccttctcaagacaggcgtcacggcagacatcgtaatctatagtggcttattcaagtgcctctgcgacttgaagtgcacagaggaggctttggatatgctgctccacagaatgccgaacgacgtaagtgatgccatctcctactcagtaattctcaagagtctttgcgacaacgggaggagccagcttgcgcttgacgtgctccatataatgaccaaaaaaggtgctgactactccccggatgtgtttgcatacaacatggtaatcgatggcttctttaaggaaggtgaagtaagcaaagcatgcgatctgttccatgaaatgatacaacagggggttgtgcccgatgtggcgatgtatacctccattatcaatgcgctatgcaaagcaagagcaatggacaaggcagaggtggttcttcgatcaatggttcataatggtgtccaaccagatgttgtgacatatactatcctgatccaaggatattcaactttgagacagttgaaagaagtcgctaggttgttgaaagtgatgagaagccaaggtgttatgccaagcgttgttacctacaactcactcatgacctgcctttgcaagaatggaagattcaaggaagctgtagaaattttttattcaatggctgtgaagggcctaaaacctaatgtcatctcatactctataatactccatggatacgctaaagaaggatcccttgttgccatgattgatctctatcagttgatggcagcagaaggggtcatacttgacctccattgtttcaacatactaattgctgcatatgctgaatatggaatgatggatgtggctatgcttttcttcgaagacatgttgaagcagggggtgaaccctaatgaagtcacaaattttgtctgtgatagctggattatgcaaaatgggcaggatgga

SEQ ID NO: 2515 - DNA, 1299 bp, Triticum aestivum; identical to SEQ ID NO: 2513

SEQ ID NO: 2516 - DNA, 1299 bp, Triticum aestivum; identical to SEQ ID NO: 2513

SEQ ID NO: 2517 - DNA, 1299 bp, Triticum aestivum; identical to SEQ ID NO: 2513

SEQ ID NO: 2518 - DNA, 1299 bp, Triticum aestivum; identical to SEQ ID NO: 2513

SEQ ID NO: 2519 - DNA, 1203 bp, Triticum aestivum
atggcccgagcaggccgtcgccaggcgacaacacccaccatttacacctacaacatactaatggagtgttgccaccgagcatgctgcccagacctagggcttgccttcttcggccgcctcctcaagacaggcatcccgacaaacatcattgactacagcagcttgttcaagtgcctctgtgacatgaagcgcacagaggaggctctgaacgtgctgctccataagatgcccgacgacctgcctaatgtcatctcctactcagtgattctcaagagcttctgcgacaatgggaggagccagcttgcgcttgatctgctccagatgatggccaaaaaaggcgctgaccactcccccgacgtgatgtcatataacatggtaattggtggcttctttaaggagggtgaagtaagcaaagcatgcgatctattccaagaaatgatacgacacgggattgtgcctactgaggtgacatatagctccattatcaatgcgctatgcaaagcaagagcaatggacaaggcagaggtggttcttcgatcaatggttcataatggtgcccaaccagatgctgtgacatataatagcttgatccaaggatattcaactttgggacagttgaaagaagtcgctaggttgttgaaagtgatgagaagccaaggtgttatgccaagcgttgttacctacaactcactcatgacctgcctttgcaagcatggaaaaaccaaagaagctgagaaaatattttattctatggccgtgaacggacgaaaacctgatgtcatctcatactctattttgctccatgggtacgctaaagaaggatccctcattgatatgattgatctctgtgagcggatgccaagagatggagttgtacccaacctccattgtttcaacatactgattaatgcatatgctaagcatggaatgatggatgtggccctgcttttcttcgaagatatgttgaagcaggtggtgaagcctaatgaattcacttatttaactgtgatatctgcattttgcaagatgggcaggatggatgatgcgatggaaaaattccgtgagatgattgatatgggagtaccagttgacacagaagtttacatgtgcatagttgagggttattttaaaaatggtgattcagtgaaagccaaggattttattaccaaaatgattccaaataggccacagaagggtaattat

SEQ ID NO: 2520 - DNA, 1284 bp, Triticum aestivum
atgttttctcctacactattcttttcaagtctctgcaacgagaaaagaagccaagaggctctcgagctgattcacatcatggttgaccatggaggtagttgccaacctaatgtggtgtcctataacactgtagttgatggcctgttgaaagagggtgaggcaggcaaggcttacagcctattttctgaaatgctgcgtcaggggatatcaccggatgttgtgacctgtagttcaatcatcgctggcatctgcaaggttcatgcgatggacaaggctgagcaggttcttcaacagatgcttgatagaggaattctgccaaatgttgctacatatactagtctaatacatggatattattcattaggacagtgcgaagaggtggatcgggttctcaaggaaatgtctagaaatggtgttcaaccaaatattgtaacttacaatatacagattgattatctttgcaagagtggaagatgtgcagaagctaggaagatttttgattctatgatcagtttgggccaaaaaccgactgttactacctacagtattctgcttcatgggtatgctatagaaaaatcttttcatcatatgcattgtctcattgatttgatggtggaaaatagtattgcaccagatcattttgtctacaacatactcatatctgcatatgctaaagaagaaatggttagtgaggtattgcatatatttacaaaaatgcggcagcaaggattgaaccctaatgtagcgagctacggtgtgataataaacttgctttccagtattggccgaatggatgatgctatgtccaaattcaatcaaatgataactgaaggattagctcctaatatcatagttttcagtaccgttattagtggtttttattcttgtggcgcatgggagagggttcatgaaatattttctgaaatgttgaatcgtggcatctatcctgctaccgtgttcttcaacataattatggaccacctttgcaaagagggaagggttatggaagcccaggatatcttcgacctgatggtacacatgggtgtgaagcctgtcgtccataattataaaacactgatacatggatactggtcagttagtaagatggatgaagtgagcaagttacttgacaatgtggtcttaattggcatggaaccagatgttgtcacctataacacactgattgacggttactctaagaatggaaggatagatgatgcattggttgttttcagggaaatgatggcgggaaggttaagccttctgttatcacttttactatta

SEQ ID NO: 2521 - DNA, 1239 bp, Triticum aestivum
atgtcccgcctccgccactcctccgccacgccgatctccagcctccgcctcctccgccacatctcctcttccacctccacccccacccccacgtcgccaacctcatgctcctggtcaccccatgccgcctttggcgcggccacggagcgtgtccgtgccgggacactcaggccggaagacgcacacaccctgttcgacgaattgcttcggcaggccacaccggtccccgagcgctccctcaacggcttccttgccgccctcgcccgcgcgcccgcctccggcaactgcatcagagatggccccgcccttgcagtggctctcttcagccgtgtgtgcagagaggaagccggcccgcaggtggcggcgctcacagtttgcacctacaacatcctcatggactgctgctgccgtgcgcgtcgcccggagctagggcttgccttatttggccgcttcctcaggaagggcctcaagacagaccagaccggcgccagcaccttcctcaagtgcctctgctacgcaaaacggacggatgaggcagtggacgttttgcttcataggatgtccgagcttgggtgtgtgcctgatgccatctcatacaacactgttctgaagagcttatgcgacaatggcatgagccagcgggggctcgaactgctccagctggtggcgggaaaaggaggtggctgcttccctgatgtggtggcgtatagcacggtcatccatggcttttttcaggagggtgaagcagggaaggcatgcagtctattccatgaaatgatgcagcaagggattgtgcccagtgtggtgacatatagctcgatcattgatgcgttgtgcaaggccagagcaatggacagggcagagctagtccttcggcagatggttgctaatggtgctcaacccgatacagtgacatataattgcatgatcaatggatatgccacatctgggcggttgaaagagtctgctaaaatgttcagagaaatgaaaagccggggtcttatgccagatattgttacttgcaactccttcctgtcctccctttgcaagcatggaagaagcaaagaagctgcagaattttttgattccatgaccgccaagggccacaaaccggatatcgtctcataccgtattttgcttcatgggtatgctactgaaggatgctttgctgatatgattgacctctttaatgcaatggaaaggaatggcattgcagccgactgcgtgttttcaacatat

SEQ ID NO: 2522 - DNA, 1239 bp, Triticum aestivum
atgtcccgcctccgccactcctccgccacgccgatctccagcctccgcctcctccgccacatctcctcttccacctccacccccacccccacgtcgccaacctcatgctcctggtcaccccatgccgcctttggcgcggccacggagcgtgtccgtgccgggacactcaggccggaagacgcacacaccctgttcgacgaattgcttcggcaggccacaccggtccccgagcgctccctcaacggcttccttgccgccctcgcccgcgcgcccgcctccggcaactgcatcagagatggccccgcccttgcagtggctctcttcagccgtgtgtgcagagaggaagccggcccgcaggtggtggcgctcacagtttgcacctacaacatcctcatggactgctgctgccgtgcgcgtcgcccggagctagggcttgccttatttggccgcttcctcaggaagggcctcaagacagaccagaccggcgccagcaccttcctcaagtgcctctgctacgcaaaacggacggatgaggcagtggacgttttgcttcataggatgtccgagcttgggtgtgtgcctgatgccatctcatacaacactgttctgaagagcttatgcgacaatggcatgagccagcgggggctcgaactgctccagctggtggcgggaaaaggaggtggctgcttccctgatgtggtggcgtatagcacggtcatccatggcttttttcaggagggtgaagcagggaaggcatgcagtctattccatgaaatgatgcagcaagggattgtgcccagtgtggtgacatatagctcgatcattgatgcgttgtgcaaggccagagcaatggacagggcagagctagtccttcggcagatggttgctaatggtgctcaacccgatacagtgacatataattgcatgatcaatggatatgccacatctgggcggttgaaagagtctgctaaaatgttcagagaaatgaaaagccggggtcttatgccagatattgttacttgcaactccttcctgtcctccctttgcaagcatggaagaagcaaagaagctgcagaattttttgattccatgaccgccaagggccacaaaccggatatcgtctcataccgtattttgcttcatgggtatgctactgaaggatgctttgctgatatgattgacctctttaatgcaatggaaaggaatggcattgcagccgactgcgtgttttcaacatat

SEQ ID NO: 2523 - DNA, 1239 bp, Triticum aestivum; identical to SEQ ID NO: 2522

SEQ ID NO: 2524 - DNA, 1239 bp, Triticum aestivum; identical to SEQ ID NO: 2522

SEQ ID NO: 2525 - DNA, 1239 bp, Triticum aestivum; identical to SEQ ID NO: 2522

SEQ ID NO: 2526 - DNA, 1239 bp, Triticum aestivum; identical to SEQ ID NO: 2522

SEQ ID NO: 2527 - DNA, 1173 bp, Triticum aestivum
atgggacacgtcattaagttgggatttgcagcacaagctgtcgtcaatttcagccacctactcaaggccatctgtgcggagaagaagaccagctatgcaatggacatcgtactccgagtaatccccatgtttaactgtgtgccggatgtcttctcctacagcattcttttcaagggtctttgcaacgaaaggagaagccaagaggctcttgagctgattcacatcatggtacagcatggaggtagctgccaacctaatgtggtgtcctatagcaccgtaattgatggcttgttgaaagagggtgagatgaacaaggcttacagtctattttgtgaaatgttacagtggggaatttcgccgaatgttgtgacctgtaattcaattatctctggcatgtgcaagcttcatgcaatggacaaggctgaggaggttcttcaacagatgcttgatagaggaattctgccaaatagtaccacatataatggcctgatacatgggtattattcactaggacagtgcgaagaggtgggtcggattttcaaggaaatgtctagaaatggtgttcaaccaaatattgtaacttacaatatacagatggattatctttgcaagagcggaagatgcgcagaagctaggaagatttttgattctatggtcagtttgggccaaaaaccagatgttactacctacggcattctgcttcatgggtatgctatggaacgatcttttcatgatattcattgtctcattgatttgatggtcggaaatggtctgtcaccaaataactatatctacagcatactcatatctgcatgtgctaaagaaaaaatggttgatgaggcaatgcatatatttacaaaaatgcagcagcaaggatttaaccctgatgtagtgagctatggaatggtgatagacttgctttccagtattggccgaatggatgatgctatgtcccaattcaatcaaatgataaccgaagggttagctcctgatatcatagtttcaacccccttattagtggtttctgttcttgtggcaaatgggagaaggttcatgaactattttctgagatgttggatcgcagcatctgtcccgacagagtgttcttcaacactgatatggatcacctttgcaaaagtggaagggttatggaagcccaggatatcttcgacc

SEQ ID NO: 2528 - DNA, 1173 bp, Triticum aestivum; identical to SEQ ID NO: 2527

SEQ ID NO: 2529 - DNA, 1218 bp, Triticum aestivum
atgacggatgaagctatgctcatatttacggaaatgcgggaaaaaggagtaggtcccgatgcgttcacctattccactgtaatagccgcactttccagaatgggtaggttgaccgatgctatgggcaagttaagtcagatgattgccatgggagttcaaccggacacagctgtttatcactccctgattcagggttgttgtatacatggtgatttggttaaagccaaggagctggtttctgaaatgatgaacaaaggtattcctcgtcctagcattgcgttcttcagttcagtgataaactatttatgcaaagaaggcagggttatggatgcacatgatatctttgaccttgttatagacatgggtgagaggcctgatgtcattacatttaattcactgattgacggatattgcttagttgataagatggataaagcactcagagtgcttgattccatggtatcatttggcattgagcctaatgtggttacatataatacacttgttaatggctactgtacaaacggaaggatcgatgatggtttgaccctgtttagagaaatgccgcataagagaattaaacctgacactgtaacatatggcatcatactggatgggttgtttcgttctgggagcactgttgctgctaggaaaatgttccatgagatgacggaaagtggaataacagtgagtatttccacatacagtataatacttggaggtttttgtagaaataattgtgcagacgaagctatcaccctgttccagaaattaggaacaatgaatgtgaagtttgatattgcaatactcaataccatgattaatgcaatgtacaaggttgggagaagagaagaagctaaggatttgtttgctgcaatatcacccagtagcttggtgcccaatgaatctacttatgcagtaatgataaaaattcttctaaaagacggagcagtggaagatgctgacaatatgttttcatcaatggacaacagtggtatcgttcccagttcccgtcttataaatgatatcatcagaatgttgttggaaaaaggtgagatagccaaggctggaaattatttgtctaaagttgatgggaagagtatctcacttgaagcttcaactgcctcattgatgttgtctctcttttcaaggaaagggaaacatcaggaggatattaagttgctccctgcaaagtatcaattttttgatggatttggt

SEQ ID NO: 2530 - DNA, 1218 bp, Triticum aestivum
atgacggatgaagctatgctcatatttacggaaatgcgggaaaaaggagtaggtcccgatgcgttcacctattccactgtaatagccgcactttccagaatgggtaggttgaccgatgctatgggcaagttaagtcagatgattgccatgggagttcaaccggacacagctgtttatcactccctgattcagggttgttgtatacatggtgatttggttaaagccaaggagctggtttctgaaatgatgaacaaaggtattcctcgtcctagcattgcgttcttcagttcagtgataaactatttatgcaaagaaggcagggttatggatgcacatgatatctttgaccttgttatagacatgggtgagaggcctgatgtcattacatttaattcactgattgacggatattgcttagttgataagatggataaagcactcagagtgcttgattccatggtatcatttggcattgagcctaatgtggttacatataatacacttgttaatggctactgtacaaacggaaggatcgatgatggtttgaccctgtttagagaaatgccgcataagagaattaaacctgacactgtaacatatggcatcatactggatgggttgtttcgttctgggagcactgttgctgctaggaaaatgttccatgagatgacggaaagtggaataacagtgagtatttccacatacagtataatacttggaggtctttgtagaaataattgtgcagacgaagctatcaccctgttccagaaattaggaacaatgaatgtgaagtttgatattgcaatactcaataccatgattaatgcaatgtacaaggttgggagaagagaagaagctaaggatttgtttgctgcaatatcacccagtagcttggtgcccaatgaatctacttatgcagtaatgataaaaattcttctaaaagacagagcagtggaagatgctgacaatatgttttcatcaatggacaacagtggtatcgttcccagttcccgtcttataaatgatatcatcagaatgttgttggaaaaaggtgagatagccaaggctggaaattatttgtctaaagttgatgggaagagtatctcacttgaagcttcaactgcctcattgatgttgtctctcttttcaaggaaagggaaacatcaggaggatattaagttgctccctgcaaagtatcaattttttgatggatttggt

SEQ ID NO: 2531 - DNA, 1218 bp, Triticum aestivum; identical to SEQ ID NO: 2529

SEQ ID NO: 2532 - DNA, 1218 bp, Triticum aestivum; identical to SEQ ID NO: 2529

SEQ ID NO: 2533 - DNA, 1218 bp, Triticum aestivum; identical to SEQ ID NO: 2529

SEQ ID NO: 2534 - DNA, 1218 bp, Triticum aestivum; identical to SEQ ID NO: 2529

SEQ ID NO: 2535 - DNA, 1233 bp, Triticum aestivum
atgcctcgcttctcctccaccacgtcaatgtcgtcactccgcctccgcctccccctccgcctgcacgcccgccactcctcctccgcctctcaaccctcacacagccagggctgggatccccacgccgccttcgccgccgccacggagcgtgcgcgctctggcagcctcaccccggcggacgcacaccacctgttcgacgaattgctgcggcaggccaatcctgtccaggagcgccccctcaacaactttctcgccgccctcgcccgcgcgccggccctcacggtcgccctcttcagcctcatatccaaaggcgcccgccgacgggtggcgcagccaaatgtcttcacctatggcgtccttatggactgctgctgccgtgcacaccgcccggatctggcactagcgttcttcggccgtttcctcaggacgggcctggaggcagaccaagtcgtcttcaacaccctcctcaagggcctttgccatgcaaagcaggcagatgaggccgtgaacgtgcttcttcacaggatgcctgacctgggctgcactcccaatgtggtggcgtacaacaccgtcatccatggcttctttagggaaggccaagtaggcaaggcatgcgatatgttccatggaatggcacataagggcgttatgcctaatgtggtgacatataactcggttattgatgcactgtgcaaggccagggccatggacaaagcagagacggtccttagtcaaatggtaaatgatggtgtcggacctaataatgtcacatatgatagcctcatccatggatattcctctttgggtaatttgaaggaggcggttagggtattcaaagagatgagtcggaggtttacaccagatgtcgttacctgcacctcactcatggccttcctttgcaagaatggaaaaagcaaagaagctgcagaaatttttgattcaatggccaccaagggcctgaaacgtgacaccgtttcatatgctattctccttcatgggtatgccactgaaggatgcttggttgacatgattaatctcttcaattcaatggcaacagactgtattctacctaactgtcatatcttcaatatactgattaatgcatatgctaaatctgggaagcttgataaggctatgcttatcttcaatgaaatgcagaaacaaggagtgagtccagatttaaccagatggttgatatgggagtacgaccgaatgcaattgtttatcattccc

SEQ ID NO: 2536 - DNA, 1233 bp, Triticum aestivum
atgcctcgcttctcctccaccacgtcaatgtcgtcactccgcctccgcctccccctccgcctgcacgcccgccactcctcctccgcctctcaaccctcacacagccagggctgggatccccacgccgccttcgccgccgccacggagcgtgcgcgctctggcagcctcaccccggcggacgcacaccacctgttcgacgaattgctgcggcaggccaatcctgtccaggagcgccccctcaacaactttctcgccgccctcgcccgcgcgccggccctcacggtcgccctcttcagcctcatatccaaaggcgcccgccgacgggtggcgcagccaaatgtcttcacctatggcgtccttatggactgctgctgccgtgcacaccgcccggatctggcactagcgttcttcggccgtttcctcaggacgggcctggaggcagaccaagtcgtcttcaacaccctcctcaagggcctttgccatgcaaagcaggcagatgaggccgtgaacgtgcttcttcacaggatgcctgacctgggctgcactcccaatgtggtggcgtacaacaccgtcatccatggcttctttagggaaggccaagtaggcaaggcatgcgatatgttccatggaatggcacataagggcgttatgcctaatgtggtgacatataactcggttattgatgcactgtgcaaggccagggccatggacaaagcagagacggtccttagtcaaatggtaaatgatggtgtcggacctaataatgtcacatataatagcctcatccatggatattcctctttgggtaatttgaaggaggcggttagggtattcaaagagatgagtcggaggtttacaccagatgtcgttacctgcacctcactcatggccttcctttgcaagaatggaaaaagcaaagaagctgcagaaatttttgattcaatggccaccaagggcctgaaacgtgacaccgtttcatatgctattctccttcatgggtatgccactgaaggatgcttggttgacatgattaatctcttcaattcaatggcaacagactgtattctacctaactgtcatatcttcaatatactgattaatgcatatgctaaatctgggaagcttgataaggctatgcttatcttcaatgaaatgcagaaacaaggagtgagtccagatttaaccagatggttgatatgggagtacgaccgaatgcaattgtttatcattccc

SEQ ID NO: 2537 - DNA, 1227 bp, Triticum aestivum
atgccatgccagcatccgccgtggcccgcgccggcgcgcccgaccacctgtgaattgtcacgactcacctccgccgccgctcgcgctgagctgattcccgcatccgccgccgccgcctctcctcttccacctcgctgccctcgagctgctgtgctcctggcgacgccgccaagcctccactccaccacgcccatgtcccgcatccgccttcgccgcagccgcctcttctcctcctgcgccaccaccccgccgcccgcaggctcctggtctccccacgccgccttcgccgcggccacagagcgcgccctcgccgggaagctcagcggggaggacgcacaccacctgttcgatgaattgctgcggcaggccaccccggtccccgagcgctccctcaacggattccttactgccctcgcccgtgcaccggactcctccactttcagaaatggccctgccctcgcccgtgcaccggactcctccactttcagaaatggccctgccctcgccatcgccctcttcaaccgcctgtgccgagaagaagccggctcgcgggtggcgtggcccacggtctgcacctacaacatcctcatggactgccgctgccgcacgcgtcgcccggatctagggcctgccttccttgggcgcctcctcaggacgggcctgaagacaaaccagatcgtcgccaacaccctcctcaagtgcctctgctacgccaaacggacggatgaggctgtcaatgtattgcttcacaagatgtccgagctcggctgtgtgcctgatgccatctcatacaacacagttcttaagagattatgtgaagatagcagaagccagggagcactcgacctgctccggacggtggcaaaagaaggaggtgttggctctctcgatgtggtatcccatggcactgtcatccatggcttctttaaggaaggcgaaacaggcaaggcatgcaatctattccatgaaatgacacaacaagggattgtgcccaatgtggtgacatataacttgattattgatgcgttgtgcaaggccagagcaatggacaaggcagagctgatccttcggcagatggttgataacggtgttcgacccgatacagttacttgcagctcgatcatgtcttccctttgcaagcatggaagaagcaaagaagctgcagaaatttttgactccatgactgccaaaggcctcaaagctgatgttttctcatattctgtttca

SEQ ID NO: 2538 - DNA, 1227 bp, Triticum aestivum; identical to SEQ ID NO: 2537

SEQ ID NO: 2539 - DNA, 672 bp, Triticum aestivum
atgccatgccagcatccgccgtggcccgcgccggcgcgcccgaccacctgtgaattgtcacgactcacctccgccgccgctcgcgctgagctgattcccgcatccgccgccgccgcctctcctctttcacctcgccgccctcgagctgctgtgctcctggcgacgccgccaagtctccactccaccacgcccatgtcccgcatccgccttcgccgcagccgcctcttctcctcctgcgccaccaccccgccgcccgcaggctcctggtctccccacgccgccttcgccgcggccacagagcgcgccctcgccgggaagctcagcggggaggacgcacaccacctgttcgatgaattgctgcggcaggccaccccggtccccgagcgccccctcaacggattccttactgccctcgcccgtgcaccggactcctccactttcagaaatggccctgccctcgcccgtgcaccggactcctccactttcagaaatggccctgccctcgccatcgccctcttcaaccgcctgtgccgagaagaagccggctcgcgggtggcgtggcccacggtctgcacctacaacatcctcatggactgctgctgccgcacgcgtcgcccggatctagggcctgccttccttgggcgcctcctcaggacgggcctgaagacaaac

SEQ ID NO: 2540 - DNA, 1227 bp, Triticum aestivum; identical to SEQ ID NO: 2537

SEQ ID NO: 2541 - DNA, 1101 bp, Triticum aestivum
atgccagtgatgcctcgcttctactccactacgcccatgccccgcctcctccgccgcctctcctccacctccacctccacctcggggccctcacgctgctgggatcccagcgccgccctcgccgcggccacagagcgggtccgcgccgggacgctcagcccggcagacgcacgccacctgttcgacgaattgctgcagcggccaaccccggtccctggtcaagccctgaacggcttcctcgccgcccttgcccgcgctccggcctccgccgcctgcggagacagccccgccctcgccgtgtctctcttcaaccgcctgtgccgagaagccagcccgcatgcgtcgcctcttacagtccacacctacagcatcctcatggactgctgctgccgcgcgcgtcgccctgacctggggcttgccttcttcggccgcctcctcaggacgggcctgaggacagacggcgtcgacgcatacgccctcatcaagtgcttctgcctcgcaaaacggacagacgaggctgtcagcgtgctgctccataggttgtctgaactcggctgtgtgcctgatgccttatcatactccgtcgttctgaaggtcttatgcgatgatagcaggagccagcgagcgctcgacctgctccggatgatgtcgaaagaaggaggtgtctgcgcccccaacgtggtgccatatagcacggtcatccacggcttctgcaaggaaggcaaagtaagcaaggcatgcgatctgttcaacaaaatggggcagcaaggagttaagcctaatgtggtgacatatacctcgataattgatgcgctgtgcaaggccagagcaatggacaaggcagagtcattccttcggcatatggtcgataatgatgttcgacccaacaacgtgacatataagtgtatcatccagggatattcctctttgggcttgtggaatgaggcagtaaaaatattcagagaaatgacaagccggggtcttatgctagatgatgttactcgcaactcattcgtggcctccctttgcaaccatggaagaagcaaggaagctgcggagattgcccatcagatgattgaaagtgaaactacagtgagcaac

SEQ ID NO: 2542 - DNA, 1101 bp, Triticum aestivum
atgccagtgatgcctcgcttctactccactacgcccatgccccgcctcctccgccgcctctcctccacctccacctccacctcggggccctcacgctgctgggatcccagcgccgccctcgccgcggccacagagcgggtccgcgccgggacgctcagcccggcagacgcacgccacctgttcgacgaattgctgcagcggccaaccccggtccctggtcaagccctgaacggcttcctcgccgcccttgcccgcgctccggcctccgccgcctgcggagacagccccgccctcgccgtgtctctcttcaaccgcctgtgccgagaagccagcccgcatgcgtcgcctcttacagtccacacctacagcatcctcatggactgctgctgccgcgcgcgtcgccctgacctggggcttgccttcttcggccggctcctcaggacgggcctgaggacagacggcgtcgacgcatacgccctcatcaagtgcttctgcctcgcaaaacggacagacgaggctgtcagcgtgctgctccataggttgtctgaactcggctgtgtgcctgatgccttatcatactccgtcgttctgaaggtcttatgcgatgatagcaggagccagcgagcgctcgacctgctccggatgatgtcgaaagaaggaggtgtctgcgcccccaacgtggtgccatatagcacggtcatccacggcttctgcaaggaaggcaaagtaagcaaggcatgcgatctgttcaacaaaatggggcagcaaggagttaagcctaatgtggtgacatatacctcgataattgatgcgctgtgcaaggccagagcaatggacaaggcagagtcattccttcggcatatggtcgataatgatgttcgacccaacaacgtgacatataagtgtatcatccagggatattcctctttgggcttgtggaatgaggcagtaaaaatattcagagaaatgacaagccggggtcttatgctagatgatgttactcgcaactcattcgtggcctccctttgcaaccatggaagaagcaaggaagctgcggagattgcccatcagatgattgaaagtgaaactacagtgagcaac

SEQ ID NO: 2543 - DNA, 1101 bp, Triticum aestivum; identical to SEQ ID NO: 2541

SEQ ID NO: 2544 - DNA, 1101 bp, Triticum aestivum; identical to SEQ ID NO: 2542

SEQ ID NO: 2545 - DNA, 1101 bp, Triticum aestivum; identical to SEQ ID NO: 2541

SEQ ID NO: 2546 - DNA, 1101 bp, Triticum aestivum; identical to SEQ ID NO: 2541

SEQ ID NO: 2547 - DNA, 1110 bp, Triticum aestivum
atgccagccgcccgcctgtcctccttcaaggctccttcacgagagcgccgacctcccctcgccgccttggctgccgccacggagcgcgtccgcgccggaacgctaagtcggcaggacgcgcaccacctgttcgacgaattgctgagccaagccgcgacagtcccagtacgcaagctgaacaactttcttgccgccctcgcccgtgcaccgccctcaactgcctgcagcgatggtccgggccttgccatcgccctcttcaaccgcatgtcccgaggcgctggtgcacgggtggtgtcgcccacgctctgtacctattccatcctcattgactgctgctgccgtgcacgccgcccggacttggtggttgccttcttcggccgcctcctcaggttggggctgctcttggaggtcatctccttcaacaatctcctcaaggggctttgccaggccaagcgctcaaatgaggctttggacatgctgctccaccggacacctgaactacactgtgcgcctgatgtcttctcgtacaacatagtaatcaacggctgcttgaaagaaggtgaagtagacaaagcgtgcaatctcttccatgagatgccccaactgggagttcaacctgatgtggtgacctacacctcaatcatggacgcactaagcaagtccggagcaatggacaaggcagaagtgctccttcggcaaatggttgatcaaggaattgaacccaatatcaagacatatagctatctgatccatggatattctacttttggtcagtggaaggaggcacttagggtattcaaagaaatggcaagtcttggtgttgtaccagacgttgtcacgttgacctcattaatcgattccctttgcaagcacagaaggacaaaggaagctagagaaatttttgactctatggctgcaaagggcctgaaacctaatatcgtctcctactctactatgcttaatgggtatgtcaaagaaggatccttcgaggatatgactgatctcttcaattcgatggtacggaatggtatcgtacctaaccaccatattttcaacatactgatcaatgcatatgctaaacgtggaggagtgaagtgcactgtaggtcct

SEQ ID NO: 2548 - DNA, 1068 bp, Triticum aestivum
atgtctcgcctccgtctccgcctcccccgcggcagctcctcccccaccacactgataccccgcctccggctcctccgccgctgctccacctccacctccacgtcgtcgccctcacgctcctggtctccccgagacgcctttgccgcggccacggagcgtgttcgcgccgggacgctcagcctggaagacgctcacaaactgttcgacgaattgctcggtcaggccaccccggtcccggagcgctccctgaacggcttccttgccgccctcgcccgcgcgcccgcctccggtgcctgcatcagagatggccccgcccttgcagtggctctcttcaaccgtgtgtgcagagaggaagccggcgcgcaggtggcggcgctcacagtttgcacctacaacatcctcatggactgctgctgccgtgcgcgtcgtccggacctagggcttgccttatttggctgcttcctcaggaagggcctgaagacagaccagaccggcgccaacaccttcctcaagtgcctctgctacgcgaaacggacggatgaggctgtgaacgtgctcctccacaggatgtccgagctcggctgtgtgcctaatgccgtttcgtacaacactgttctgaagggcttatgcgacaatagcatgagtcagcgggcgctcgacctgctccagatggtggcgggaaaaggaggtggctgcttccctgatgtggtggcgtatagcacggtcatccatggcttttttaaggagggtgaaacagggaaggcatgcagtctattccatgaaatgatgcagcaagggattgtgcccagtgtggtgacatataactcgattattgatgcgttgtgcaaggtcagagaagtggacaaggcagagctagtccttcgtcagatggttgctaaaggtgctcaacccgatacagtgacatataattgcatgatcaatggatatgccacatctgggcggttgaaagccggggtcttacaccaaatgttgttacttgcaactcgttcctggcctccctttgcaagcaccgaagtagcaaagaagctgcagaattttttgattcca

SEQ ID NO: 2549 - DNA, 993 bp, Triticum aestivum
atggcgccaaatcattttgtctacaacatactcatatctgcatatggtcaagaagaaacggttggtgaggtaatgcatatatttacaaaaatgcggcaggaaggattgaaccctgatgttgcgaactatggagcggtaataaacttgctttctagtatcggccgaatggatgatgctaagtcccaatacaatcaaatgataactgaaggattactccctggtatcattgttttcaccccccttattagtggtttctgttcttgtggcaaatgggagaaggttcctgaactattttctgagatgttggatcgcggcatctgtcccaatacagtgttcttcaacgcaattatggatcgcctttgcaaaaatggaagggttatggaagcccaggatctcttcgacctgatggtacacatgggtgtgaagcctgatgtgtgtacttataacacactgataggtggatacttgttcgttggtaagatggatgaagtaaggaagttacttgacaatatggtctcaattggcttgaaaccagatgttatcacatatagcatactgattgatggttactctaagaatggaaggatagatgatgcattggttgtttccagggaaatgttggccgggaaggttaagccttgtgttatcacttttaatattatgattggtgcattgcttaaatgtggcaggaaggcagaaaccaaagatttgtttgacggtatctgggccaacggattagtgcccgacgttattacatatagcttaatgatacaaaaacttattgaagaaggttctctacaagagtctgatgatctattcctttctatggagaagaatggatgtgttgccgactcccatatgctaaatgctatagttagaagcttacttcggaaaggggaggtgcccagggctgggacttatctatctaaaattgatgagagggtgttcacccttgaagcttccacttgcttcaggggggaaaggccaagaata

SEQ ID NO: 2550 - DNA, 1233 bp, Triticum aestivum
atgtgggccagccacctgttggacccacatgtcatagacacaaaggtaggtgccttaatgcacggaagcatcgtcccctctgcgcgcgcctcccgacagctcacgcgccagagtgtcccgcatccgccgccggtcaccctcctcctcctcctcctcctctacctagccgacgtccggcttccgcctccgctgctcctccacttcatcacgctgatgtccagcatccacctccgccactgctccactatgcccatgtcccacgtctgcctccgccgccgcctttcctcatcctcctcctccttctccaactgcacctcgccgccctcaccaccctggtctccccacgccgcatttgccgcggccacagagcgtgtacgagccaggacgctcagcccggaagacgcacaccacctgttcgacgtattgtttcagcaggccactccggtccccgagcgctcccttgatggattccttgcagcactcagccgcgctacgccctctgaagcctgcggagacggccccgccctcgccctcaccctcttcaaccgtgtctgccgagaagaagccgggatgcaggtggtgccgcccaccatcttcacctacggcatcctcatgaactgctgctgccgcgaacgtcgtccggacctagggcttgccttctttgggcgcatcctcaaggctggcctgaagacaaacctgatcaccgccaacaccgtcctcaagtgcctctactgcgcaaaacataccgacgaggctgtcgatatgctgcttcataggatgtccgaccttggctgtgtgcctgatgacttctcatacaacacagttctccacggcttctttaaggaaggaaaaataggcaaggcctgcaatctattccatgaaatgatgctgcaagggtttgtccctgatgtggtgacatataacttgattattgaagcattgtgcaaggcccgagcaatggacaatgcagagttgttcctacggcagatggttgataacgttgttccaccggataaagtgacatatactagcatgatccatggatattccactttgggccggtggaaagaggcgactaaaatgttcagagagatgacaagcaggggtcttatacctaatattgtcacatggagctcgttcatggactccctttgcaagcatgggaaaagcaaagaagctgcagaaattttcttttccatggctggaaagggccataagcctaatatcgtctcc

SEQ ID NO: 2551 - DNA, 1014 bp, Triticum aestivum
atgtccagcatccacctccgccactgctccactatgcccatgtcccacgtctgcctccgccgccgcctttcctcatcctcctcctcctccaactgcacctcgccgccctcaccaccctggtctccccacgccgcatttcccgcggccacagagcgtgtacgagccaggacgctcagcccggaagacgcacaccacctgttcgacgtattgtttcagcaggccactccggtccccgagcgctcccttgatggattccttgcagcactcagccgcgctacgccctctgaagcctgcggagacggccccgccctcgccctcaccctcttcaaccgtgtctatcgagaagaagccgggatgcaggtggtgccgcccaccatcttcacctacggcatcctcatgaactgctgctgccgcgaacgtccggacctagggcttgccttctttgggcgcatcctcaaggctggcctgaagacaaacctgatcgccgccaacaccgtcctcaagtgcctctactgcgcaaaacataccgacgaggctgtcgatatgctgcttcataggatgtccgaccttggctgtgtgcctgatgacttctcatacaacacagttctccacggcttctttaaggaaggaaaaataggcaaggcccgcaatctattccatgaaatgatgctgcaagggtttgtccctgatgtggtgacatataacttgattattgaagcattgtgcaaggcccgagcaatggacaatgcagagttgttcctacggcagatggttgataacgttgttccaccagataaagtgacatatactagcatgatccatggatattccactttgggccggtggaaagaggcgactaaaatgttcagagagatgacaagcaggggtcttatacctaatattgtcacatggagctcgttcatggactccctttgcaagcatgggaaaagcaaagaagctgcagaaattttcttttccatggctggaaagggccataagcctaatatcgtctcc

SEQ ID NO: 2552 - DNA, 1014 bp, Triticum aestivum; identical to SEQ ID NO: 2551

SEQ ID NO: 2553 - DNA, 1020 bp, Triticum aestivum
atgtccagcatccacctccgccactgctccactatgcccatgtcccacgtctgcctccgccgccgcctttcctcatcctcctcctccttctccaactgcacctcgccgccctcaccaccctggtctccccacgccgcatttgccgcggccacagagcgtgtacgagccaggacgctcagcccggaagacgcacaccacctgttcgacgtattgtttcagcaggccactccggtccccgagcgctcccttgatggattccttgcagcactcagccgcgctacgccctctgaagcctgcggagacggccccgccctcgccctcaccctcttcaaccgtgtctgccgagaagaagccgggatgcaggtggtgccgcccaccatcttcacctacggcatcctcatgaactgctgctgccgcgaacgtcgtccggacctagggcttgccttctttgggcgcatcctcaaggctggcctgaagacaaacctgatcaccgccaacaccgtcctcaagtgcctctactgcgcaaaacataccgacgaggctgtcgatatgctgcttcataggatgtccgaccttggctgtgtgcctgatgacttctcatacaacacagttctccacggcttctttaaggaaggaaaaataggcaaggcctgcaatctattccatgaaatgatgctgcaagggtttgtccctgatgtggtgacatataacttgattattgaagcattgtgcaaggcccgagcaatggacaatgcagagttgttcctacggcagatggttgataacgttgttccaccggataaagtgacatatactagcatgatccatggatattccactttgggccggtggaaagaggcgactaaaatgttcagagagatgacaagcaggggtcttatacctaatattgtcacatggagctcgttcatggactccctttgcaagcatgggaaaagcaaagaagctgcagaaattttcttttccatggctggaaagggccataagcctaatatcgtctcc

SEQ ID NO: 2554 - DNA, 1014 bp, Triticum aestivum; identical to SEQ ID NO: 2551

SEQ ID NO: 2555 - DNA, 1176 bp, Triticum aestivum
atgcacggaagcatcgtcccctctgcgcgcgcctcccgacagctcacgcgccagagtgtcccgcatccgccgccggtcaccctcctcctcctcctcctcctctacctagccgacgtccggcttccgcctccgctgctcctccacttcatcacgctgatgtccagcatccacctccgccactgctccactatgcccatgtcccacgtctgcctccgccgccgcctttcctcatcctcctcctccttctccaactgcacctcgccgccctcaccaccctggtctccccacgccgcatttgccgcggccacagagcgtgtacgagccaggacgctcagcccggaagacgcacaccacctgttcgacgtattgtttcagcaggccactccggtccccgagcgctcccttgatggattccttgcagcactcagccgcgctacgccctctgaagcctgcggagacggccccgccctcgccctcaccctcttcaaccgtgtctgccgagaagaagccgggatgcaggtggtgccgcccaccatcttcacctacggcatcctcatgaactgctgctgccgcgaacgtcgtccggacctagggcttgccttctttgggcgcatcctcaaggctggcctgaagacaaacctgatcaccgccaacaccgtcctcaagtgcctctactgcgcaaaacataccgacgaggctgtcgatatgctgcttcataggatgtccgaccttggctgtgtgcctgatgacttctcatacaacacagttctccacggcttctttaaggaaggaaaaataggcaaggcctgcaatctattccatgaaatgatgctgcaagggtttgtccctgatgtggtgacatataacttgattattgaagcattgtgcaaggcccgagcaatggacaatgcagagttgttcctacggcagatggttgataacgttgttccaccggataaagtgacatatactagcatgatccatggatattccactttgggccggtggaaagaggcgactaaaatgttcagagagatgacaagcaggggtcttatacctaatattgtcacatggagctcgttcatggactccctttgcaagcatgggaaaagcaaagaagctgcagaaattttcttttccatggctggaaagggccataagcctaatatcgtctcc

SEQ ID NO: 2556 - DNA, 663 bp, Triticum aestivum
atgcaggtggtgccgcccaccatcttcacctacggcatcctcatgaactgctgctgccgcgaacgtcgtccggacctagggcttgccttctttgggcgcatcctcaaggctggcctgaagacaaacctgatcaccgccaacaccgtcctcaagtgcctctactgcgcaaaacataccgacgaggctgtcgatatgctgcttcataggatgtccgaccttggctgtgtgcctgatgacttctcatacaacacagttctccacggcttctttaaggaaggaaaaataggcaaggcctgcaatctattccatgaaatgatgctgcaagggtttgtccctgatgtggtgacatataacttgattattgaagcattgtgcaaggcccgagcaatggacaatgcagagttgttcctacggcagatggttgataacgttgttccaccggataaagtgacatatactagcatgatccatggatattccactttgggccggtggaaagaggcgactaaaatgttcagagagatgacaagcaggggtcttatacctaatattgtcacatggagctcgttcatggactccctttgcaagcatgggaaaagcaaagaagctgcagaaattttcttttccatggctggaaagggccataagcctaatatcgtctcc

SEQ ID NO: 2557 - DNA, 1221 bp, Triticum aestivum
atggctatgaagggcctgaaacctgacaacgtttcatatgctattctccttcatgggtatgccaccgaaggatgcttagttgatatgattaatctcttcaattcaatggaaagaaactgtattctacctgactgttgtatcttcaacatactgattaatgcatatgctaaatctgggaagcttgataaggctatgcttatcttcaatgaaatgcagaaacaaggagtgagtccagatgcagtcacatatttacccgtaatagatgcattttgcaaaaagggtaggttggacgatgctatgattatgtttaatcagatgattgatacgggagtacgaccagacacagctgtttatacttccctaatccaaggtttttgtacacacggcgatttggtgaaagcaaaggaattggttactgaaatgatgaacaaaggtatacctcctcctgatattaagttcttccattcaatcatgcagaacctatgcacagaaggaagggtaatagaagcacgggatatccttggcttgatagcacacataggtatgaggcctaatgtttgcacatttaatatactgattggtggatactgcctagtccgcaagatggaggatgcctcaaaaatatttgatgatatgatgtcatatggtttagaaccttctaatattacttatggtatacttattaatggctattgcaaaaacttaaggattgacgatgggctgattctgttcaaagaaatgttgcgcaagggagttaaacctacaacttttaattataacgtcatactggatgggttatttctggctggacgaactgttgctgcaaaggaaaagtttcatgagatggctgaatctggagcagatgtgtgcattgatacatactgtatagttcaccgcagccagcacaagaagaggcatggccggaatgaggctcggccaccgggaggacgccggacagccggatgcacgagggcccatagcaccaccacggccagtccaagaggaggcctggccgggacgaggtcctgccgtcgggaggacgccggacagccaggccacgggaatgggtggccaggcgaggtggagcgcatgggagggtgggaggaggaggatgcgtcgcaccgggcagtgccggcgacgatggcaaggaggagccgcggaggcgatcccagatccgccaccaggaggggtcgcggggaggagcaccgccatgacgaccac

SEQ ID NO: 2558 - DNA, 1221 bp, Triticum aestivum; identical to SEQ ID NO: 2557

SEQ ID NO: 2559 - DNA, 1221 bp, Triticum aestivum; identical to SEQ ID NO: 2557

SEQ ID NO: 2560 - DNA, 1221 bp, Triticum aestivum; identical to SEQ ID NO: 2557

SEQ ID NO: 2561 - DNA, 1221 bp, Triticum aestivum
atggctatgaagggcctgaaacctgacaacgtttcatatgctattctccttcatgggtatgccaccgaaggatgcttagttgatatgattaatctcttcaattcaatggaaagaaactgtattctacctgactgttgtatcttcaacatactgattaatgcatatgctaaatctgggaagcttgataaggctatgcttatcttcaatgaaatgcagaaacaaggagtgagtccagatgcagtcacatatttacccataatagatgcattttgcaaaaagggtaggttggacgatgctatgattatgtttaatcagatgattgatacgggagtacgaccagacacagctgtttatacttccctaatccaaggtttttgtacacacggcgatttggtgaaagcaaaggaattggttactgaaatgatgaacaaaggtatacctcctcctgatattaagttcttccattcaatcatgcagaacctatgcacagaaggaagggtaatagaagcacgggatatccttggcttgatagcacacataggtatgaggcctaatgtttgcacatttaatatactgattggtggatactgcctagtccgcaagatggaggatgcctcaaaaatatttgatgatatgatgtcatatggtttagaaccttctaatattacttatggtatacttattaatggctattgcaaaaacttaaggattgacgatgggctgattctgttcaaagaaatgttgcgcaagggagttaaacctacaacttttaattataacgtcatactggatgggttatttctggctggacgaactgttgctgcaaaggaaaagtttcatgagatggctgaatctggagcagatgtgtgcattgatacatactgtatagttcaccgcagccagcacaagaagaggcatggccggaatgaggctcggccaccgggaggacgccggacagccggatgcacgagggcccatagcaccaccacggccagtccaagaggaggcctggccgggacgaggtcctgccgtcgggaggacgccggacagccaggccacgggaatgggtggccaggcgaggtggagcgcatgggagggtgggaggaggaggatgcgtcgcaccgggcagtgccggcgacgatggcaaggaggagccgcggaggcgatcccagatccgccaccaggaggggtcgcggggaggagcaccgccatgacgaccac

SEQ ID NO: 2562 - DNA, 1215 bp, Triticum aestivum
atggctatgaagggcctgaaacctgacaacgtttcatatgctattctccttcatgggtatgccaccgaaggatgcttagttgatatgattaatctcttcaattcaatggaaagaaactgtattctacctgactgttgtatcttcaacatactgattaatgcatatgctaaatctgggaagcttgataaggctatgcttatcttcaatgaaatgcagaaacaaggagtgagtccagatgcagtcacatatttacccataatagatgcattttgcaaaaagggtaggttggacgatgctatgattatgtttaatcagatgattgatacgggagtacgaccagacacagctgtttatacttccctaatccaaggtttttgtacacacggcgatttggtgaaagcaaaggaattggttactgaaatgatgaacaaaggtatacctcctcctgatattaagttcttccattcaatcatgcagaacctatgcacagaaggaagggtaatagaagcacgggatatccttggcttgatagcacacataggtatgaggcctaatgtttgcacatttaatatactgattggtggatactgcctagtccgcaagatggaggatgcctcaaaaatatttgatgatatgatgtcatatggtttagaaccttctaatattacttatggtatacttattaatggctattgcaaaaacttaaggattgacgatgggctgattctgttcaaagaaatgttgcgcaagggagttaaacctacaacttttaattataacgtcatactggatgggttatttctggctggacgaactgttgctgcaaaggaaaagtttcatgagatggctgaatctggagcagatgtgtgcattgatacatactgtatagttcaccgcagccagcacaagaagaggcatggccggaatgaggctcggccaccgggaggacgccggacagccggatgcacgagggcccatagcaccaccacggccagtccaagaggaggcctggccgggacgaggtcctgccgtcgggaggacgccggacagccaggccacgggaatgggtggccaggcgaggtggagcgcatgggagggtgggaggaggaggatgcgtcgcaccgggcagtgccggcgacgatggcaaggaggagccgcggaggcgatcccagatccgccaccaggaggggtcgcggggaggagcaccgccatgac

SEQ ID NO: 2563 - DNA, 1173 bp, Triticum aestivum
atgtacatttcaagtttggacctgaaatttttaggagttgtagccacattccttgcgaacattcacattttattccgaaatttttggaaatatttaagatatatttttaaacatggagcaccgggagtatataaggatggaagtaccagatattctcccggccgtgcccatcccatgcctcgcctctaccccaccacgcccatgctccgcctcctccccctgccttcacgccgctgggatccccgcggggcctttgcctcagccacggagcgcgcccgcgccgggacgctcagccctgaagacgcacaccacctgttcgacgaattgctactacaggccaaccccgtccccgagcgctccctcaacggcttccttgccgcgctcgcccgcgctccgtcctccgctgctctcagagatggaccctcccttgctctcggcctcttcaaccgcgtctgccgagaagaagcaggaccgcgggtggtgccgcccacagtctgcacatacaacatcctcatggacagctgctgccgtgcacgccgtccggacctaggccttgccttcttcgaccgcttcctcaggatgggcctcaaggcagaccagatcgtcgccaacaacctcctcaagtgcctctgccacgcaagacggacacatgaggctatcaacgtgctgcttcataggatgtctgagttcggatgtgtgcctaatgtcatctcatactctatagtacttaagagcttatgtgacgatagcaggagccagcaagcgttcgacctgctccagatggtgaggaaagaaggaggtgccggctccctcaatgtggtggcgtatagcacagtgattcatgctttctttaaggaaggggaagcaagcaaggcatgtgatctattccatgagatgatgcagcaagggattgtgcctaatgtggtgacatatagctcgattattgatgccttgtgcaaggtcagggcaatggacaaggcaaagttggtccttcagcagatggttgataatggtgttcgaccaaatatgtatacatggaactcattcatgtactccctttgcaagaatggaagaagcaaagaagctgcagaattttttgactccatgacccccaagggccttaaacctaatatcgtcgtgtactctactcttcttcacgggtatgctagcgaa

SEQ ID NO: 2564 - DNA, 1173 bp, Triticum aestivum; identical to SEQ ID NO: 2563

SEQ ID NO: 2565 - DNA, 1173 bp, Triticum aestivum; identical to SEQ ID NO: 2563

SEQ ID NO: 2566 - DNA, 1173 bp, Triticum aestivum; identical to SEQ ID NO: 2563

SEQ ID NO: 2567 - DNA, 1173 bp, Triticum aestivum; identical to SEQ ID NO: 2563

SEQ ID NO: 2568 - DNA, 1173 bp, Triticum aestivum; identical to SEQ ID NO: 2563

SEQ ID NO: 2569 - DNA, 1173 bp, Triticum aestivum
atgtacatttcgagtttggacctgaaatttttaggagttgtagccacattccttgcgaacattcacattttattccgaaatttttggaaatatttaagatatgtttttaaacatggagcaccgggagtatataaggatggaagtaccagatattctcccggccgtgcccatcccatgcctcgcctctaccccaccacgcccatgctccgcctcctccccctgccttcacgccgctgggatccccgcggggcctttgcctcagccacggagcgcgtccgcgccgggacgctcagccctgaagacgcacaccacctgttcgacgaattgctactacaggccaaccccgtccccgagcgctccctcaacggcttccttgccgcgctcgcccgcgctccgtcctccgctgctctcagagatggaccctcccttgctctcggcctcttcaaccgcgtctgccaagaagaagcaggaccgcgggtggtgccgcccacagtctgcacatacaacatcctcatggacagctgctgccgtgcacgccgtccggacctaggccttgccttcttcggccgcttcctcaggatgggcctcaaggcagaccagatcgtcgccaacaacctcctcaagtgcctctgccacgcaagacggacagatgaggctatcaacgtgctgcttcataggatgtctgagttcggatgtgtgcctaatgtcatctcatactctatagtacttaagagcttatgtgacgatagcaggagccagcaagcgttcgacctgctccagatggtgaggaaagaaggaggtgccggctccctcaatgtggtggcatatagcacagtgattcatgctttctttaaggaaggggaagcaagcaaggcatgtgatctattccatgagatgatgcagcaagggattgtgcctaatgtggtgacatatagctcgattattgatgccttgtgcaaggtcagggcaatggacaaggcaaagttggtccttcagcagatggttgataatggtgttcgaccaaatatgtatacatggaactcattcatgtactccctttgcaagaatggaagaagcaaagaagctgcagaattttttgactccatgacctccaagggccttaaacctaatatcgtcgtgtactctactcttcttcacgggtatgctagcgaa

SEQ ID NO: 2570 - DNA, 993 bp, Triticum aestivum
atggcgccaaatcattttgtctacaacatactcatatctgcatatgctcaagaagaaacggttggtgaggtaatgcatatatttacaaaaatgcggcaggaaggattgaaccctgatgttgcgaactatggagcggtaataaacttgctttctagtattggccgaatggatgatgctatgtcccaatacaatcaaatgataactgaaggattactccctggtatcattgttttcaccccccttattagtggtttctgttcttgtggcaaatgggagaaggttcctgaactattttctgagatgttggatcgcggcatctgtcccaacacagtgttcttcaacacaattatggatcgcctttgcaaaaatggaagggttatggaagcccaggatctcttcgacctgatggtacacatgggtgtgaagcctgatgtgtgtacttataacacactgataggtggatacttgttcgttggtaagatggatgaagtaaggaagttacttgacaatatggtctcaattggcttgaaaccagatgttatcacatatagcatactgattgatggttactctaagaatggaaggatagatgatgcattggttttttccagggaaatgttggccgggaaggttaagccttgtgttatcacttttaatattatgattggtgcattgcttaaatgtggcaggaaggcagaaaccaaagatttgtttgatggtatctgggccaacggattagtgcccgacgttattacatatagcttaatgatacaaaaacttattgaagaaggttctctacaagagtctgatgatctattcctttctatggagaagaatggatgtgttgccgactcccatatgctaaatgctatagttagaagcttacttcggaaaggggaggtgcccagggctgggacttatctatctaaaattgatgagagggtgttcacccttgaagcttccacttgcttcaggggggaaaggccaagaata

SEQ ID NO: 2571 - DNA, 993 bp, Triticum aestivum; identical to SEQ ID NO: 2570

SEQ ID NO: 2572 - DNA, 993 bp, Triticum aestivum; identical to SEQ ID NO: 2570

SEQ ID NO: 2573 - DNA, 1089 bp, Triticum aestivum
atgtctgaactcggctgtgtgcctgatgccttgtcgtactccgtcgttctgaaggtcttgtgtgacgatagcaggagccaacgagcgctcgacctgctccagatgatgtcgaaagaaggaggtgggtgcgccccgaacgtggtggcatatagcacgttcatccatggcttctgtaaggaaggcaaagtaagccaggcatgcgatctgttcgatgaaatggtgcagcaaggagttaagcctaatgtggtgacatacacctcagtaattgatgcgctgtgcaaggcaagagcaatggacaaggcagagtcgttccttcggcatatggtcaatcatggtgttcgacccaacaacgtgacctataagtatatgatccagggttattccactttgggctggttgaaagaggcagtaaaaatatttagagaaacgacaagtaggggtcttatactagacgatgttactcgcaacttgttcgtggcctccctttgcaaccatggaagaagcaaggaagctgctgagtttgcccatcagatgattgaaactggaacaacagtgagcatttccacatacagtataattcttggagaactttgtaggaataattgcactgaggaagcaatcatactgttccgcaaattaggtgcagtgaatgtgaagttcgatattacaatattcaataccatgattgatgcaatgtacagggttcaaagaagagaagaagctaacattttgtttgctgcaatatctgccaatggattggtacctaatgcttctacttacagaataatgataacaagtattgtaaaagaaggatcaatggaagaagctgatcatatgttttcatcaatggagacgagtggttatgctcccagctccgttctgttaaatgatatcatcagaatgttgctagaaaaaggtgagatagtcaaggctggaaattatttgtctaaagttgatgggaagtgcatttcacttgaagcttcaactggtttgttgatgatgcatctattttcaagagaaggcaaatatcatgagcaaataagatcactccctgcaaggtatgaatttttcggagtcagcacagttgag

SEQ ID NO: 2574 - DNA, 1089 bp, Triticum aestivum
atgtctgaactcggctgtgtgcctgatgccttgtcgtactccgtcgttctgaaggtcttgtgtgacgatagcaggagccaacgagcgctcgacctgctccagatgatgtcgaaagaaggaggtgggtgcgccccgaacgtggtggcatataggacgttcatccatggcttctgtaaggaaggcaaagtaagccaggcatgcgatctgttcgatgaaatggtgcagcaaggagttaagcctaatgtggtgacatacacctcagtaattgatgcgctgtgcaaggcaagagcaatggacaaggcagagtcgttccttcggcatatggtcaatcatggtgttcgacccaacaacgtgacctataagtatatgatccagggttattccactttgggctggtggaaagaggcagtaaaaatatttagagaaacgacaagtaggggtcttatactagacgatgttactcgcaacttgttcgtggcctccctttgcaaccatggaagaagcaaggaagctgctgagtttgcccatcagatgattgaaactggaacaacagtgagcatttccacatacagtataattcttggagaactttgtaggaataattgcactgaggaagcaatcatactgttccgcaaattaggtgcagtgaatgtgaagttcgatattacaatattcaataccatgattgatgcaatgtacagggttcaaagaagagaagaagctaacattttgtttgctgcaatatctgccaatggattggtacctaatgcttctacttacagaataatgataacaagtattgtaaaagaaggatcaatggaagaagctgatcatatgttttcatcaatggagacgagtggttatgctcccagctccgttctgttaaatgatatcatcagaatgttgctagaaaaaggtgagatagtcaaggctggaaattatttgtctaaagttgatgggaagtgcatttcacttgaagcttcaactggtttgttgatgatgcatctattttcaagagaaggcaaatatcatgagcaaataagatcactccctgcaaggtatgaatttttcggagtcagcacagttgag

SEQ ID NO: 2575 - DNA, 1089 bp, Triticum aestivum; identical to SEQ ID NO: 2573

SEQ ID NO: 2576 - DNA, 1089 bp, Triticum aestivum; identical to SEQ ID NO: 2573

SEQ ID NO: 2577 - DNA, 1089 bp, Triticum aestivum; identical to SEQ ID NO: 2574

SEQ ID NO: 2578 - DNA, 1089 bp, Triticum aestivum; identical to SEQ ID NO: 2573

SEQ ID NO: 2579 - DNA, 1104 bp, Triticum aestivum
atgattgatacaggagtacgaccggacacggctgtttatcgttccctaatccagggattttgtacacatggcgatttggtgaaagcaaaggaatatgttactgaaatgatgaacaaaggtatgcttcctcctgatattatgttcttcagttcaataatgcagaacctatgcacggaaggaagggtaatagaagcacgggatatcctcgacttgatggtgcacataggtatgaggcctgatgttcccatctttaatttgctgataggtggatactgcctagtctgcaagatggaggatgcaacaaaagtgtttgatgatatggtgtcatatggtttagaaccttgtaacattacggatggtatgcttattaatggctattgcaaaaatagaaggattgatgacgggcttattctgttcaaagagatgctgcacaagggacttaaacctacaacttttaattataacgtcatcttggatggattatttctggctggacgaactgttgccgcaaaggaaaagtttaatgagatggttgaatctggagtaagtatgtgcatcagtacttactctatagttcttggtggactttgtagaaatagttgcagtagcgaagcaatcacactattccagaaattaagcacgatgaatgtgaaatttgatattagaattgtcaatatcatgattggtgcattctacagggttcggcgaaaccaagaagctaaggatttgtttgccgcaataccatcaaatggcttggcagctaatgtagttacctacagcataatgataataaatcttataaaagaaggttcagtggaagaagctgacaatctttttttatctatggaaaagagtggttgtaccgctgactcttgtatgttaaatcatattatcagaaggctactggaaaaaggagagatggtcaaggctggaaattatatttctaaagttgatgcaaatagctactcacttgaagctaaaactgtttcgctgctgatctctctgttttcaaggaaagggaaatatagagaacacatcacattgctccctacaaagtatcagtttcgtgaagaagcggccacagttgagttgtttgatacatgg

SEQ ID NO: 2580 - DNA, 1104 bp, Triticum aestivum; identical to SEQ ID NO: 2579

SEQ ID NO: 2581 - DNA, 1104 bp, Triticum aestivum; identical to SEQ ID NO: 2579

SEQ ID NO: 2582 - DNA, 1104 bp, Triticum aestivum; identical to SEQ ID NO: 2579

SEQ ID NO: 2583 - DNA, 1104 bp, Triticum aestivum; identical to SEQ ID NO: 2579

SEQ ID NO: 2584 - DNA, 1104 bp, Triticum aestivum; identical to SEQ ID NO: 2579

SEQ ID NO: 2585 - DNA, 1188 bp, Triticum aestivum
atgcgggaaaaaggagtgagtcctgatgtagtcacctataccactgtaatagccgcactttccagaatgggtaggttgaccgatgctgtggacaaatttgatgagatgattgcaatgggagtacagccaagcatacctgtttatcagtccctgattcagggtttttgcatcgatggtgatttggttaaagccaaggagctggtttctgaaatgatgaacaaaggtattccttgtcctaacattgtgttcttcaattcagtaataaacagtctgtgcaaagaaggaagggttatggatgcacatgatatctttgacttggttatagacataggtgagaggcctgataccattacatttagttcactgattgacggatattgcttagtcggcaagatggataaagcattcggaatgcttaatgccatggaatcagttggtgttgagcctgatattgttacttacagtacactgcttgatggctattttaaaaatggaaggatagacgatggtttgactctgttcagagaaatgccgcgaaagagaattaaacctgacactgttacatatggcatcatactggatgggttgtttcgttctgggagaactgttgctgcatggaaaatgttccatgagatgatcgaaagtggaacaacagtgaccttttccatatacgctataatacttggaggtttttgtagaaataattgcgcagacgaagctatcaccctgttccacaaattaggtgcaatgaatgtgaagttcaatattgcaatagtcaataccatgatcaatgcaatgtacaaggttgggagaagagaagaagctaaggaactatttgctggaatattagcccgtgggttggtgcctaatgaatctacttacggagtaatgataaaaaatcttctaaaagatggagtagtggaagatgctaacaatgtgttttcatcaatggacaagagtggtatagtccccagctcccgtctcatcaatgacatcatcagattgttgttggaaaaaggtgagatcgccaaggccggatattatttgtctaaagttgatgggaagagcatatcacttgaagcttcaactacttcattgatgttttctctcttctcaatgaaaggcaaatataaggagcacatgaaattgctccctgccaagtatcaatttttcgatgagttggttgac

SEQ ID NO: 2586 - DNA, 831 bp, Triticum aestivum
atgataaaatgcaacacggaagcaaatgacaagacaacaacaacgaataactggaagacacctggcgcaacggtctcggggcgttacactgatattgttacttacagtacactgcttgatggctattttaaaaatggaaggatagatgatggtttgactctgttcagagaaatgccgcgaaagagaattaaacctgacactgttacatatggcatcatactggatgggttgtttcgttctgtgagaattgttgctgcatggaaaatgttccatgagatgatcgaaagtggaacaacagtgaccttttccatatacgctataatacttggaggtttttgtagaaataattgcgcagacgaagctatcaccctgttccacaaattaggtgcaatgaatgtgaagttcaatattgcaatagtcaataccatgatcaatgcaatgtacaaggttgggagaagagaagaagctaaggaactatttgctggaatattagcccgtgggttggtgcctaatgaatctacttacggtgtaatgataaaaaatcttctaaaagatggagcagtggaagatgctaacaatgtgttttcatcaatggacaagagtggtatagtccccagctcccgtctcatcaatgacatcatcagattgttgttggaaaaaggtgagatcgccaaggccggatattatttgtctaaagttgatgggaagagcatatcacttgaagcttcaactacttcattgatgttttctctcttctcaaggaaaggcaaatataaggagcacatgaaattgctccctgccaagtatcaattttttgatgagttggttgac

SEQ ID NO: 2587 - DNA, 1188 bp, Triticum aestivum; identical to SEQ ID NO: 2585

SEQ ID NO: 2588 - DNA, 1188 bp, Triticum aestivum; identical to SEQ ID NO: 2585

SEQ ID NO: 2589 - DNA, 1188 bp, Triticum aestivum; identical to SEQ ID NO: 2585

SEQ ID NO: 2590 - DNA, 1188 bp, Triticum aestivum; identical to SEQ ID NO: 2585

SEQ ID NO: 2591 - DNA, 1188 bp, Triticum aestivum; identical to SEQ ID NO: 2585

SEQ ID NO: 2592 - DNA, 1188 bp, Triticum aestivum
atggatcctacggcccgtatagaaggccaatattcaaccgtaatacatacattttgcaaaaagggtaggttggatgatgctgtgataaagtttaatcagatgattgatacaggagtacgaccggacacggctgtttatagttccctaatccagggattttatacacatggagatttggtgaaagcaaaggaatatgttactgaaatgatgaagaaaggtatgcttcctcctgatattaagttcttccattcaatcatgcagaacctttgcacagaaggaagggtaatagaagcacgggatgtccttggcttgatagcgcacataggtatgaggcctgatgtttgcacatttaatatactgatcggtggatactgcctagtcggcaagatggaggatgcctcaaaaatatttgatgatatgatgtcatatggcttagaaccttctaatattacgtatggtatacttattaatggctattgcaaaaatagaaggattgatgacgggcttattctgttcaaagagatgctgcacaagggacttaaacctacaacttttaattataacgtcatactggatggattatttctggctggacgaactgttgctgcaaaggaaaagtttgatgagatggttgaatctggagtaagtgtgtgcattggtacatattcgacagttcttggtggactttgtagaaataattgtagcggcgaagcaatcacgctattccagaaattaagcacaatggatgtgaaattcaatattataattgtcaatataatgattgatgctttctacaaggttcagcgaaaccaagaagccaaggatttgtttgctgcagtatcagccaatggtttggtagctaatgtctttacctacaccataatgatgaaaaatcttataaaagaagggtcagtgggagaagctgacgatctctttttatcaatggagaagagctgctgtactgctgactcttatatgttaaatcttatcgtcagaatgttactgggaaaaggagagatagtcaaggctgggaattatatatctaaaattgatgcaaagagctactcacttgaagctaaaactgtttcgctgcttatctctctcttttcagggaaagggaaatatagagaacacataggattgctccatacaaagtatccgtttcgtgaagaagcagccacggttgtg

SEQ ID NO: 2593 - DNA, 1188 bp, Triticum aestivum
atggatcctacggcccgtatagaaggccaatattcaaccgtaatacatacattttgcaaaaagggtaggttggatgatgctgtgataaagtttaatcagatgattgatacaggagtacgaccggacacggctgtttatagttccctaatccagggattttatacacatggagatttggtgaaagcaaaggaatatgttactgaaatgatgaagaaaggtatgcttcctcctgatattaagttcttccattcaatcatgcagaacctttgcacagaaggaagggtaatagaagcacgggatgtccttggcttgatagcgcacataggtatgaggcctgatgtttgcacatttaatatactgatcggtggatactgcctagtcggcaagatggaggatgcctcaaaaatatttgatgatatgatgtcatatggcttagaaccttctaatattacgtatggtatacttattaatggctattgcaaaaatagaaggattgatgacgggcttattctgttcaaagagatgctgcacaagggacttaaacctacaacttttaattataacgtcatactggatggattatttctggctggacgaactgttgctgcaaaggaaaagtttgatgagatggttgaatctggagtaagtgtgtgcattggtacatattcgacagttcttggtggactttgtagaaataattgtagcggcgaagcaatcacgctattccagaaattaagcacaatggatgtgaaattcaatattataattgtcaatataatgattgatgctttctacaaggttcagcgaaaccaagaagccaaggatttgtttgctgcagtatcagccaatggtttggtagctaatgtctttacctacaccataatgatgaaaaatcttataaaagaagggtcagtggaagaagctgacgatctctttttatcaatggagaagagcggctgtactgctgactcttatatgttaaatcttatcgtcagaatgttactgggaaaaggagagatagtcaaggctgggaattatatatctaaaattgatgcaaagagctactcacttgaagctaaaactgtttcgctgcttatctctctcttttcagggaaagggaaatatagagaacacataggattgctccctgcaaagtatcggtttcgtgaagaagcagccacagttgtg

SEQ ID NO: 2594 - DNA, 1185 bp, Triticum aestivum
atggtaagtctgggccaaaaaccgaccgttactacctacagcattttgctccatgggtatgctatggagcaatcttttcatgagatgcattgtctcattgatttgatggtgggaaatggtattgcgccaaatcattttgtctacaacatactcatatctgcatatgctcaagaagaaacggttggtgaggtaatgcatatatttacaaaaatgcggcaggaaggattgaaccctgatgttgcgaactatggagcggtaataaacttgctttctagtattggccgaatggatgatgctatgtcccaatacaatcaaatgataactgaaggattactccctggtatcatagttttcaccccccttattagtggtttttgttcttgtggcaaatgggagaaggttgatgaactattttctgagatgttggatcgcggcatctgtcccgacacagtgttcttcaacactgttatggatcacctttgcaaaaatggaagggttatagaagcccaggatctcttcgacctgatggtacacatgggtgtgaagccttttgtccgtgattacaacacactgatacatggatactgtttagttggtaagatggatgaagggaggaagttacttgacaatatgtgctcaattggcttgaaaccggatgatttcacctatagcatactgattgatggttactctatgaagggaaggataggtgatgcattgattgttgtcagggaaatgttggacaggaaggttaaaccttctattatcacttttaatattatgattggtgcgttgcttaaaggtggcagaaaggaagaagccaaagatttgtttgatggtatctgggccaaaggattagtgcctgacgttgttacatatagattaatgatacaaaagcttatagaagaaggttctctacaagattctgatgatctattcctttctatggagaagaatggatgtgttgccgactcccgtatgctaaatgctatagttagaagcttacttcagaaaggggacgtgccgagggctgggacttatctgtctaaaattgatgagaggaggttcacctttgaagcttccactgctagcttattgacttcacttgcgtcaggggggaaaggccaggaatataaggagttactccctgaagaataccactcttttctggaacagggcactggt

SEQ ID NO: 2595 - DNA, 1185 bp, Triticum aestivum; identical to SEQ ID NO: 2594

SEQ ID NO: 2596 - DNA, 1185 bp, Triticum aestivum; identical to SEQ ID NO: 2594

SEQ ID NO: 2597 - DNA, 1122 bp, Triticum aestivum
atggaacaatcttttcatgagatgcattgtctcattgatttgatggtgggaaatggtattgcgccaaatcattttgtctacaacatactcatatctgcatatgctcaagaagaaacggttggtgaggtaatgcatatatttacaaaaatgcagcaggaaggattgaaccctgatgttgcgaactatggagcggtaataaacttgctttctagtattggccgaatggatgatgctatgtcccaatacaatcaaatgataactgaaggattactccctggtatcatagttttcaccccccttattagtggtttctgttcttgtggcaaatgggagaaggttgatgaactattttctgagatgttggatcgcggcatctgtcccgacacagtgttcttcaacactgttatggatcacctttgcaaaaatggaagggttatagaagcccaggatctcttcgacctgatggtaaacatgggtgtgaagccttttgtccgtgattacaacacactgatacatggatactgtttagttggtaagatggatgaagggaggaagttacttgacaatatgtgctcaattggcttgaaaccggatgatttcacctatagcatactgattgatggttactctatgaagggaaggataggtgatgcattgattgttgtcagggaaatgttggacgggaaggttaaaccttctattatcacttttaatattatgattggtgcgttgcttaaaggtggcagaaaggaagaagccaaagatttgtttgatggtatctgggccaaaggattagtgcctgacgttgttacatatagattaatgatacaaaagcttatagaagaaggttctctacaagagtctgatgatctattcctttctatggagaagaatggatgtgttgccgactcccgtatgctaaatgctatagttagaagcttacttcagaaaggggacgtgccgagggctgggacttatctgtctaaaattgatgagaggaggttcacctttgaagcttccactgctagcttattgactgcacttgcgtcaggggggaaaggccaggaatataaggagttactccctgaagaataccactcttttctggaacagggcactggt

SEQ ID NO: 2598 - DNA, 1122 bp, Triticum aestivum
atgtctcgcctccgcctcctccgccgcagctcctcctccaccacactgataccccgcctccggctcctccgccgctgctccacctccacctccacctcaccgccctcaggcccctggtctccccgagacgcttttgtcgccgccatagagcgtgttcgcgccgggacgctcagcccggaagacgctcaccacctgttcgacgatttgctcggtcaagccaccccggtccccgatcgcaccatgaacggcgtcctcgcccgtgccacgtcccccgccgcctgcatcagagatggccccgcccttgccgtcgctctcttcaaccgtgtgtgccgagaagaggccggtccgcatgtggcggcgcccacagtccacacctatggcatcctcatggactgctgctgccgcgcacgtcgcccggacctagggcttgccttattcggccgcttcctcaggacaggcctgaaggcaaacgagatcgtcgccaccaccttcctcaagtgcctctgctgcgcgaaacggacagaagaggctgtgaaagtactgcttcacaggatgcccgagctgggctgtgtgcctaatgccatctcgtactccatagttttgaaaagcttgtgtgaaaatagcatgagtcagcaggcactcgacctgctccagatggcgacaaaagaaggaggctgccttcctgatgtggtggcatatagcgcaatcatccatggcttctttaaggagggcgaaatagacaaggcatgccatctattccatgaaatgatgcggcaaggggttgtgccgactgtggtgacatacaacataataattgatgcgttgtgcaaggccggagaaatggacaaggcagagctagtctttcagcggatggctcgtaatggtgcgcggcctaataaagcgacatgtaatggcagtaaatttagttcactgactgacggatattgctcagtcgccaagatggataaaacattcaaactgcttgatgccatgatatcagttggaattgagcctgatgctgttacttatagtgcacttcttgatggctattttaaaaatggaaggatcgatgatggtttgaccctatttagagaaatgtcgtgcgagttaaacctacaactg

SEQ ID NO: 2599 - DNA, 1122 bp, Triticum aestivum; identical to SEQ ID NO: 2598

SEQ ID NO: 2600 - DNA, 1122 bp, Triticum aestivum
atgtctcgcctccgcctcctccgccgcagctcctcttccaccacactgataccccgcctccggctcctccgccgctactccacctccacctccacctcaccgccctcaggcccctggtctccccgagacgcttttgtcgccgccatagagcgtgttcgcgccgggacgctcagcccggaagacgctcaccacctgttcgacgatttgctcggtcaagccaccccggtccccgatcgcaccatgaacggcgtcctcgcccgtgccacgtcccccgccgcctgcatcagagatggccccgcccttgccgtcgctctcttcaaccgtgtgtgccgagaagaggccggtccgcatgtggcggcgcccacagtccacacctatggcatcctcatggactgctgctgccgcgcacgtcgcccggacctagggcttgccttattcggccgcttcctcaggacaggcctgaaggcaaacgagatcgtcgccaccaccttcctcaagtgcctctgctgcgcgaaacggacagaagaggctgtgaaagtactgcttcacaggatgcccgagctgggctgtgtgcctaatgccatctcgtactccatagttttgaaaagcttgtgtgaaaatagcatgagtcagcaggcactcgacctgctccagatggcgacaaaagaaggaggctgccttcctgatgtggtggcatatagcgcaatcatccatggcttctttaaggagggcgaaatagacaaggcatgccatctattccatgaaatgatgcggcaaggggttgtgccgactgtggtgacatacaacataataattgatgcgttgtgcaaggccggagaaatggacaaggcagagctagtctttcagcggatggctcgtaatggtgcgcagcctaataaagcgacatgtaatggcagtaaatttagttcactgactgacggatattgctcagtcgccaagatggataaaacattcaaactgcttgatgccatgatatcagttggaattgagcctgatgctgttacttatagtgcacttcttgatggctattttaaaaatggaaggatcgatgatggtttgaccctatttagagaaatgtcgtgtgagttaaacctacaactg

SEQ ID NO: 2601 - DNA, 1122 bp, Triticum aestivum; identical to SEQ ID NO: 2598

SEQ ID NO: 2602 - DNA, 1122 bp, Triticum aestivum; identical to SEQ ID NO: 2598

SEQ ID NO: 2603 - DNA, 1122 bp, Triticum aestivum; identical to SEQ ID NO: 2598

SEQ ID NO: 2604 - DNA, 1122 bp, Triticum aestivum; identical to SEQ ID NO: 2598

SEQ ID NO: 2605 - DNA, 1053 bp, Triticum aestivum
atgaagctcaaaatgcctgggcccggcggaataatcactctcgttagtaatccgtacatagcactccgcgctgaaaacaagacagccgcattagccttagaggcactatccgaagccctagcggcagaggaactcaccgcgctgcgctctacggtgaatagggacgatgtgatactcgataagagatccaagtccacctcctttaaaccagcggatgaaatagtcaaattccaagtccacccaacggaccctaccaaaacaacctccatcagggcacagttaaaccccgttgtggacgccgcactacgagagttcctgcgcgagaattgggacatattcgcctggcatccttcagacatgccaggaatcccacgcaggctggccgagcatagcctcaatatcctaaagggagttataaacaacctgagcaaagaaggaaatgtaaaggatgcacaagatatgtttgacttcattgtaggtattggtcatcagcctgatgttattatgtacaattcactgatggatggatattgccttgttggcaaggtggaggaagcaatgacagtgcttgatgctatgaagtccgctggcctccaacctgatgctattacgtatgctatacttcttaatggctactgtaaaattggaaggatcgacgatggattgagtctttttagggaaatctcactcagcagggttaagcccacgactattatgtacaacattatacttgatgggctgttttgctgtgggagaacagtttttgcaaaggaagaattcgatacaatgattgaaagtggcataccggtgggcattgacacatgcaccatagttcttagtggactttgcaaaaataattgcactgatgaagcaatagagctgttcaagaagttatgtgcaatgaatgtgaagtttgatgtcataattctcactaccatgatttctgcaatgtttaagactaggagaattgaagaagccaaggatttgtttgctactatatcaaccatagggttggtgccttctgttgtgacttacagtgtaattttttttttt

SEQ ID NO: 2606 - DNA, 942 bp, Triticum aestivum
atggactgctgctgccgggcgcgtcgcccggatctagggcctgctttccttgggcgcctcctcaggacgggcctgaagacaaaccagatcgtcgccaacaccctcctcaagtgcctctgctacgccaaacggacggatgaggctgtcaatgtattgcttcacaagatgtccgagctcggctgcgtgcctgatgccatctcatacaacacagttcttaagagcttatgtgaagatagcagaagccaggaagcactcgacctgctctggatggtggcaaaagaaggaggtgtcggctctctcgatgtggtatcccatagcactgtcatccatggcttctttaaggaaggcgaaacaggcaaggcatgcaatctattccatgaaatgacacatcaagggattgtgcccaatgtgatgacatataacttgattattgctgcgttgtgcaaggccagagcaatggacaaggcagagctgatccttcggcagatggttgataacggtgttcgacccaatacagttacttgcagctcgctcatgtcttccctttgcaagcatggaagaagcaaagaagctgcagaaatttttgactccatgactgccaagggcctcaaacctgatatcgtcgcatactctattctgcttcatggatatgccactgaaggatgccttgctgatatgattgatctcttcaattcaatgaaaaacaatggtattgaagccacttgtcaagttttcaacatattaattggtgcatatgctaaatgtggaatgatggatgaggctatgctcatatttactgaaatgcggcgacaaggagtgagtccggatgtattcacctatacaactgtaatagtctcactttttcgaacgagtagactggccgatgctattgacaaattcgatgagatgattgccattggagtacagccaaacagacctgtt

SEQ ID NO: 2607 - DNA, 942 bp, Triticum aestivum; identical to SEQ ID NO: 2606

SEQ ID NO: 2608 - DNA, 942 bp, Triticum aestivum
atggactgctgctgccgggcgcgtcgcccggatctagggcctgctttccttgggcgcctcctcaggacgggcctgaagacaaaccagatcgtcgccaacaccctcctcaagtgcctctgctacgccaaacggacggatgaggctgtcaatgtattgcttcacaagatgtccgagctcggctgcgtgcctgatgccatctcatacaacacagttcttaagagcttatgtgaagatagcagaagccaggaagcactcgacctgctctggacggtggcaaaagaaggaggtgtcggctctctcgatgtggtatcccatagcactgtcatccatggcttctttaaggaaggcgaaacaggcaaggcatgcaatctattccatgaaatgacacatcaagggattgtgcccaatgtgatgacatataacttgattattgctgcgttgtgcaaggccagagcaatggacaaggcagagctgatccttcggcagatggttgataacggtgttcgacccgatacagttacttgcagctcgctcatgtcttccctttgcaagcatggaagaagcaaagaagctgcagaaatttttgactccatgactgccaagggcctcaaacctgatatcgtcgcatactctattctgcttcatggatatgccactgaaggatgccttgctgatatgattgatctcttcaattcaatgaaaaacaacggtattgaagccacttgtcaagttttcaacatattaattggtgcatatgctaaatgtggaatgatggatgaggctatgctcatatttactgaaatgcggcgacaaggagtgagtccggatgtattcacctatacaactgtaatagtctcactttgtcgaacgagtagactggccgatgctattgacaaattcgatgagatgattgccattggagtacagccaaacagacctgtt

SEQ ID NO: 2609 - DNA, 942 bp, Triticum aestivum; identical to SEQ ID NO: 2606

SEQ ID NO: 2610 - DNA, 942 bp, Triticum aestivum; identical to SEQ ID NO: 2606

SEQ ID NO: 2611 - DNA, 777 bp, Triticum aestivum
atgtccgagctcggctgcgtgcctgatgccatctcatacaacacagttcttaagagcttatgtgaagatagcagaagccaggaagcactcgacctgctctggacggtggcaaaagaaggaggtgtcggctctctcgatgtggtatcccatagcactgtcatccatggcttctttaaggaaggcgaaacaggcaaggcatgcaatctattccatgaaatgacacatcaagggattgtgcccaatgtgatgacatataacttgattattgctgcgttgtgcaaggccagagcaatggacaaggcagagctgatccttcggcagatggttgataacggtgttcgacccgatacagttacttgcagctcgctcatgtcttccctttgcaagcatggaagaagcaaagaagctgcagaaatttttgactccatgactgccaagggcctcaaacctgatatcgtcgcatactctattctgcttcatggatatgccactgaaggatgccttgctgatatgattgatctcttcaattcaatgaaaaacgacggtattgaagccacttgtcaagttttcaacatattaattggtgcatatgctaaatgtggaatgatggatgaggctatgctcatatttactgaaatgcggcgacaaggagtgagtccggatgtattcacctatacaactgtaatagtctcactttttcgaacgagtagactggccgatgctattgacaaattcgatgagatgattgccattggagtacagccaaacagacctgtt

SEQ ID NO: 2612 - DNA, 942 bp, Triticum aestivum; identical to SEQ ID NO: 2606

SEQ ID NO: 2613 - DNA, 1098 bp, Triticum aestivum
atgtgcaaggcaggagcaatggacaagacagagctggtccttcggccaatggtcgataatggtgtccgaccggataaaatgatatgtaatagtatgatccatggatattcaactttgggccggtggaaagaggcgggtaaagtgttcagagaaatgacaagccggggtcttataccagatattttcacttggaactcgttcatgggctccctttgcaagcatggaagaagcaaagaagctgcagaaattttcttttccatggctgcaaagggccacaaacctaatattgtctcctacattcttcttcttcgtgtgtatgccaatgaaggaagatttgctgatatgatgagtctccttaatttaatggaaggcgacggtattgtagccaactgccaaattttcaccatattaattgatgcatatgctaaacaaggaatgattgatgaagctatgcttgtacttactgacatgcggggacaaggactgagtccggatgtattcacctattcagctctattatctgcactttgtagaatgggtaggctggctgatgctatggataagttcactcagatgattggcacgggagtacaaccgaacacagttgtttatcactccctagttcagggcttatgtacacatggtgatttggcgaaagcgaaggagttagtttctaaaatgatgaataaaggtattgctcgtccaaacattgcattgttcagttcaataatggccagtctatgcaatgaaggaagggttatggatgcacaccatatctttgacttggttacagacataggtgagaaacctaatatcattatgtttactacgctgattgatggatattgcttagtcggcaagatggacaaagcatgtggagtacttgatgccatggtatcagctggcattgagcctaatgtcgttacatatagtacacttgtcagtggatattgtaaaaatggacggatcgataatgggttgattctgttcagagacatgttgagaactgctgctgcaaagaaaatgttccgtgagattatcgaaagtagaataattgtgagcatttctacatataatataattcttgggatgactttg

SEQ ID NO: 2614 - DNA, 1098 bp, Triticum aestivum
atgtgcaaggcaggagcaatggacaagacagagctggtccttcggccaatggtcgataatggtgtccgaccggataaaatgatatgtaatagtatgatccatggatattcaactttgggccggtggaaagaggcgggtaaagtgttcagagaaatgacaagccggggtcttataccagatattttcacttggaactcgttcatgggctccctttgcaagcatggaagaagcaaagaagctgcagaaattttcttttccatggctgcaaagggccacaaacctaatattgtctcctacattcttcttcttcgtgtgtatgccaatgaaggaagatttgctgatatgatgagtctccttaatttaatggaaggcgacggtattgtagccaactgccaaattttcaccatattaattgatgcatatgctaaacaaggaatgattgatgaagctatgctcgtacttactgacatgcggggacaaggactgagtccggatgtattcacctattcagctctattatctgcactttgtagaatgggtaggctggctgatgctatggataagttcactcagatgattggcacgggagtacaaccgaacacagttgtttatcactccctagttcagggcttatgtacacatggtgatttggcgaaagcgaaggagttagtttctaaaatgatgaataaaggtattgctcgtccaaacattgcattgttcagttcaataatggccagtctatgcaatgaaggaagggttatggatgcacaccatatctttgacttggttacagacataggtgagaaacctaatatcattatgtttactacgctgattgatggatattgcttagtcggcaagatggacaaagcatgtggagtacttgatgccatggtatcagctggcattgagcctaatgtcgttacatatagtacacttgtcagtggatattgtaaaaatggacggatcgataatgggttgattctgttcagagacatgttgagaactgctgctgcaaagaaaatgttccgtgagattatcgaaagtagaataattgtgagcatttctacatataatataattcttgggatgactttg

SEQ ID NO: 2615 - DNA, 1098 bp, Triticum aestivum; identical to SEQ ID NO: 2614

SEQ ID NO: 2616 - DNA, 1098 bp, Triticum aestivum; identical to SEQ ID NO: 2614

SEQ ID NO: 2617 - DNA, 1098 bp, Triticum aestivum
atgtgcaaggcaggagcaatggacaagacagagctggtccttcggccaatggtcgataatggtgtccgaccggataaaatgatatgtaatagtatgatccatggatattcaactttgggccggtggaaagaggcgggtaaagtgttcagagaaatgacaagccggggtcttataccagatattttcacttggaactcgttcatgggctccctttgcaagcatggaagaagcaaagaagctgcagaaattttcttttccatggctgcaaagggccacaaacctaatattgtctcctacattcttcttcttcgtgtgtatgccaatgaaggaagatttgctgatatgatgagtctccttaatttaatggaaggcgacggtattgtagccaactgccaaattttcaccatattaattgatgcatatgctaaacaaggaatggttgatgaagctatgctcgtacttactgacatgcggggacaaggactgagtccggatgtattcacctattcagctctattatctgcactttgtagaatgggtaggctggctgatgctatggataagttcactcagatgattggcacgggagtacaaccgaacacagttgtttatcactccctagttcagggcttatgtacacatggtgatttggcgaaagcgaaggagttagtttctaaaatgatgaataaaggtattgctcgtccaaacattgcattgttcagttcaataatggccagtctatgcaatgaaggaagggttatggatgcacaccatatctttgacttggttacagacataggtgagaaacctaatatcattatgtttactacgctgattgatggatattgcttagtcggcaagatggacaaagcatgtggagtacttgatgccatggtatcagctggcattgagcctaatgtcgttacatatagtacacttgtcagtggatattgtaaaaatggacggatcgataatgggttgattctgttcagagacatgttgagaactgctgctgcaaagaaaatgttccgtgagattatcgaaagtagaataattgtgagcatttctacatataatataattcttgggatgactttg

SEQ ID NO: 2618 - DNA, 1098 bp, Triticum aestivum; identical to SEQ ID NO: 2614

SEQ ID NO: 2619 - DNA, 1125 bp, Triticum aestivum
atgccccgcctccgtcgcttctccaccgtgccgatgctccacctcctccgccgcagctcctcttccacctccacctcgctgccctcacacccctggtctccccacgaagcctttgccgcggccacagagcgcgtccgcgccgggacgctaaccccggaagaagcacacaacctgttcgacggcttccccggtccccagccgctccctgaacggcttccttgccgccctcgcccgtgcgccggcctccgcaacctgccgcagagatggccctgccctcgcccttgccctcttcaaccgcgtatgccgagaagaagccggcccgcaggtggcatcctcatgggctgcttctgcggtgcgcatcgcccggacctagggcttgccttatttggccgcttcctcgggacaggcctcaagacaaacaagattgtggccaccaccttcctcaagtgcctctgctacgccaaacgtacagatgaggctgtcaacttgctgcttcgtaggatgcccgagcttggctgcgtgcctgatgcaatctcatacaccattgttctgaagagcttatgcgagaatagcatgagtcagcgggcacttgacctgctccagatggtggcagaaggaggaggtgcctgctccctcaatgtggtggtgtatagcacagtcatccatggcttcttcaaggagggcgaaacaggcaaggcatgcaatctattccatgaaatgatccatcaaggggttgtgcccaatgtggtcacgtatagctcgattattgatgcgttgtgcaaggccagagcaatggacaaggcagagctagtccttcaacagatggttgatagtggtgctcaaccgaataatgtgacatataattgcatgatccatggatattccacatcagggcagttgaaagaggctgctaaaatgtttagaaaaatgacaagccatggtcttgtaccaaatgcagtcacttgcagctcgttaatgacttccctttgcaagcatggaagaagcaaagaagcggcggaaatattttattccatgactgccaagggccacaaaccggatgccgtctcgtaccgtattttgcttcatgggtatgccaatgaaggatgctttgctgatatgattgat

SEQ ID NO: 2620 - DNA, 1167 bp, Triticum aestivum
atgtttgatgtatacaagaagtgtgcaaaacgaagggaagagcttttgctcggccgaccgcttgtacacacatccgttggcttggaaatgacctcctcgccgatgtgccgcatcggcctccgccaccgccgctcctcctcctccacctcactgatgtcccgcctccgcctactcgggcgcagctcctcctccacctccacctccccgcgctcacgcccctggtctccccacgccgcctttgccgctgccacacagcgggtcagcgctgggacgttcagcccggaacacgcacaccaactgttcgacgaattgctccggcagggcactccggtccccgatttctccctggacggcttccttgccgctctcgcccgtgctacgtcctccgcggcctgcagagatggccccgccctcgcgctcgccctcttcaaccgcttatgccgagaagaagctggcccgcgggtggcgcagcccacaatcttcacctacggcgtcctcatgaactgctgcgtccgcactcgccgcccgcaactggggcttgccttcttcggccgtgtcctcaggacggacctgaagacaaacacgatcgtcttcagctccctcctcaagtgcctctgccacgccaaacggacagacgaggatgtcagcgtgctgcttcataggatgcccgagctcggttgtgtgcctgatgccttctcatacaccattgttcttaagagcttatgtgatgatagcagcagccagcgggcgctcgacctgctccagactatggagaaaggaggaggtgtctgctcccctgatgtggtgtcatataccacggtcatccacggcctccttaaggaaggggaagtaagcaaggcatgcagtctattcgatgaaatggtgcagcaaggggttgtgcctaatgtggtgacatacagctcgattattgatgcgctgtgcaaggctggagtgatggacaagacggagttggtccttcggcagatggttgatagtggcatccaaccggataacgtgacatatactagcatgatccatggatattccacgttgggccggtggaaagaagctgacaagccggggtatcataccagatgttgttacttggacctcattcatgacctccctctgcaagcatggaagaagcagagaagctgccggaattat

SEQ ID NO: 2621 - DNA, 1032 bp, Triticum aestivum
atgaagcgcacagaggaggctctgaacgtgctgctccataagatgcccaacgacctgcctaatgtcatctcctactcagtgattctcaagagcttctgcgacaatgggaggagccagcttgcgcttgatctgctccagatgatggccaaaaaaggcgctgaccactcccccgacgtgatgtcatacaacatggtaattgatggcttctttaaggagggtgaagtaagcaaagcatgcgatctattccaagaaatgatacgacaggggattgtgcctactgaggtgacatatagctccattatcaatgcgctatgcaaagcaagagcaatggacaaggcagaggtggttcttcgatcaatggttcataatggtgcccaaccagatgctgtgacatataatagcttgatccaaggatattcaactttgggacagttgaaagaagtcgctaggttgttgaaagtgatgagaagtcaaggtgttatgccaagcgttgttacctacaacttactcatgacctgcctttgcaagcatggaaaaaccaaagaagctgagaaaatattttattctatggccgtgaacggacgaaaacctgatgtcatctcatactctattttgctccatgggtacgctaaagaaggatccctcattgatatgattgatctctgtgagcggatggcaagagatggagttgtacccaacctccattgtttcaacatactgattaatgcatatgctaagcatggaatgatgggtgtggccctgcttttcttcgaagatatgttgaagcagggggtgaagcctagtgaattcacttatttaactgtgatatctgcattttgcaagatgggcaggatggatgatgcgatggaaaaattccgtgagatgattgatatgggagtaccagttgacacagaagtttacatgtgcatagttgagggttattttaaaaatggtgattcagtgaaagccaaggattttattaccaaaatgaagaacaaggatattccaaataggccgcagaagggtaattat

SEQ ID NO: 2622 - DNA, 1032 bp, Triticum aestivum; identical to SEQ ID NO: 2621

SEQ ID NO: 2623 - DNA, 1032 bp, Triticum aestivum; identical to SEQ ID NO: 2621

SEQ ID NO: 2624 - DNA, 1032 bp, Triticum aestivum; identical to SEQ ID NO: 2621

SEQ ID NO: 2625 - DNA, 1032 bp, Triticum aestivum; identical to SEQ ID NO: 2621

SEQ ID NO: 2626 - DNA, 801 bp, Triticum aestivum
atgaagcgcacagaggaggctctgaacgtgctgctccataagatgcccaacgacctgcctaatgtcatctcctactcagtgattctcaagagcttctacgacaatgggaggagccagcttgcgcttgatctgctccagatgatggccaaaaaaggcgctgaccactcccccgacgtgatgtcatacaacatggtaattgatggcttctttaaggagggtgaagtaagcaaagcatgcgatctattccaagaaatgatacgacaggggattgtgcctactgaggtgacatatagctccattatcaatgcgctatgcaaagcaagagcaatggacaaggcagaggtggttcttcgatcaatggttcataatggtgcccaaccagatgctgtgacatataatagcttgatccaaggatattcaactttgggacagttgaaagaagtcgctaggttgttgaaagtgatgagaagtcaaggtgttatgccaagcgttgttacctacaactcactcatgacctgcctttgcaagcatggaaaaaccaaagaagctgagaaaatattttattctatggccgtgaacggacgaaaacctgatgtcatctcatactctattttgctccatgggtacgctaaagaaggatccctcattgatatgattgatctctatgagcggatggcaagagatggagttgtacccaacctccattgtttcaacatactgattaatgcatatgctaagcatggaatgatggatgtggccctgcttttcttcgaagatatgttgaagcagggggatgaagcc

SEQ ID NO: 2627 - DNA, 753 bp, Triticum aestivum
atgtcaaccgcccgcctgtgctccaccttcacctcctccttgaaggctccttcacgaaaaccacgagccccccgcctcgccgccttggctgccgccacggagcgtgtccgcgctggaacgctaactcggcaggacgcgcacaagctgttcgacaaattgctgagccaagccgcgacagtcccagtacgcaagctgaacaactttcttgccgccctcgcccgtgcaccgccctcagctgcctgcagcgatggtccgggccttgccatcgccctcttcaaccgcatgtcccgaggcgctggtgcacgggtggcgtcgcccacgctctgtacctattccatcctcatggactgctgctgccgcgcaggccgcccggacttggtgcttgccttcttcagccgcctcctcaggttggggctgagcttgaatgtcatctccttcagcaatctcctcaaggggctttgccaggccaagcgctcaaatgaggctttggacatgctgctccaccggacacctgaactacactgtgcgcctgatgtcttctcgtacaacatagtaatcaacggctgcttgaaagaaggtgaagtagacaaagcgtgcaatctcttccatgagatgccccaactgggagttcaacctgatgtggtgacctacacctcaatcatggacgcactaagcaagtccggagcaatggacaaggcagaagtgctccttcggcaaatggttgatcaaggaattgaacccaatatcaagaca

SEQ ID NO: 2628 - DNA, 915 bp, Triticum aestivum
atggggcacgtcattaagttgggatttacagcagaagctattgtcaatttcaaccacctactcaaggccatctgtgcggagaagaagaccagctatgcaatggacatcgtactccgagtaatgcctgaatttaactgcacaccgaacattttctcctactacattcttttcaagggtctctgcaacgagaagagaagccaagaggctctcgagctgattcaaattatggttgaggatggaggttgctgccgacctgatgtggtgacctatagcactgtaattgatggcttgttgaaagagggtgaggtggaccaagcttacagcctattttctgaaatgctgcgtcagggggtatcaccgaatattgtgacctgtaattcaatcatctctggcatgtgcaagcttcacgcgatggacaaggctgaggaggttcttcaacagatgtttgatagaagaattctgccagatgttgccacatatactagtctaatacatggatattattcattaggacagtgcaaagaggtggatcggattctcaatgaaatgtgtaaacatggtgttcaaccagatattgtaacttacaatatacagatggattatctttgcaagagcggaaggtgcgcagaagctaggaatctattagattctttgatcggtttgggccaaaaaccagatgttactacctacagtattctgcttcatgggtatgccatggaaaaatcttttgatgagatgcattgtctcattgatttgatggtaggaaatggtgttgcaccagatcatcatatctacaacatactcatatctgcatatgctaaagaagaaacggttggtgaggtaatggatatatttacaaaaatgcggcagcaaggattgaaccctgatgttgagagaattgcatgtagtggggat

SEQ ID NO: 2629 - DNA, 915 bp, Triticum aestivum; identical to SEQ ID NO: 2628

SEQ ID NO: 2630 - DNA, 915 bp, Triticum aestivum; identical to SEQ ID NO: 2628

SEQ ID NO: 2631 - DNA, 987 bp, Triticum aestivum
atgtttgaaatgatgaacggtggtattcttcggcctaacattgtgttcttcaattcagtaataaacagtctgtacaaagaaggaagggttatggatgcacatgatgtcttagacttggttataggcataggtgagaggcctgataccattacatttagttcactgattgacggatattgcttagtcgggaagacggataaagcattcaaaatacttgatgccatggaatcagttggtgttgagcctgatattgttacttacaatacactgcttgatggctattttaaaaacagaaggattgatgatgctttgactttgtttagagaaatgccgcgtaagagaattaaacctggcactgttacatatggcatcatgttggatgggttgtttcgtgctgggagaactgttgccgcaaagaaaatgttccatgagatgaacgagagtggaacaacggtggacatttccacatacgctataatacttggaggtttttgtagaaataattgtgcagacgaagctatcaccctattccacaaattaggtgcaatgaatgtgaagttcaatattgcaatagtcaataccatgatcaatgcaatgtacaaggttgggagaagagaagaagctaaggaactatttgctggaatattagcccgtgggttggtgcctaatgaatctacttacggagtaatgataaaaaatcttctaaaagatggagcagtggaagatgctaacaatgtgttttcatcaatggacaagagtggtatagtccccagctcccgtctcatcaatgacatcatcagattgttgttggaaaaaggtgagatcgccaaggccggatattatttgtctaaagttgatgggaagagcatatcacttgaagcttcaactacttcattgatgttttctctcttctcaaggaaaggcaaatataaggagaacatgaaattgctccctgccaagtatcaatttttcgatgtgttggttgac

SEQ ID NO: 2632 - DNA, 912 bp, Triticum aestivum
atgtttgaaatgatgaacggtggtattcttcggcctaacattgtgttcttcaattcagtaataaacagtctgtacaaagaaggaagggttatggatgcacatgatgtcttagacttggttataggcataggtgagaggcctgataccattacatttagttcactgattgacggatattgcttagtcgggaagacggataaagcattcaaaatacttgatgccatggaatcagttggtgttgagcctgatattgttacttacaatacactgcttgatggctattttaaaaacagaaggattgatgatgctttgactttgtttagagaaatgccgcgtaagagaattaaacctggcactgttacatatggcatcatgttggatgggttgtttcgtgctgggagaactgttgccgcaaagaaaatgttccatgagatgaacgagagtggaacaacggtggacatttccacatacgctataatacttggaggtttttgtagaaataattgtgcagacgaagctatcaccctrttccacaaattaggtgcaatgaatgtgaagttcaatattgcaatagtcaataccatgatcaatgcaatgtacaaggttgggagaagagaagaagctaaggaactatttgctggaatattagcccgtgggttggtgcctaatgaatctacttacggagtaatgataaaaaatcttctaaaagatggagcagtggaagatgctaacaatgtgttttcatcaatggacaagagtggtatagtccccagctcccgtctcatcaatgacatcatcagattgttgttggaaaaaggcaacgaaaaaaatagcgcgctacaaaatatagcgaggcccttctccaaatgctacacaagttatagcgcgctaatagcatgctatatttcgaaa

SEQ ID NO: 2633 - DNA, 1002 bp, Triticum aestivum
atgaataggtcaagggcgatgaaggggttgaccgcggcgaggcgcgtcacggcgtcggtcgagacgacggctttgtccggcttgttgagcatgacgccggaggaggcctgtcaccgacaagtcttagacttggttataggcataggtgagaggcctgataccattacatttagttcactgattgacggatattgcttagtcgggaagacggaaaaagcattcaaaatacttgatgccatggaatcagttggtgttgagcctgatattgttacttacaatacactgcttgatggctattttaaaaacagaaggattgatgatgctttgactttgtttagagaaatgccgcgtaagagaattaaacctggcactgttacatatggcatcatgttggatgggttgtttcgtgctgggagaactgttgccgcaaagaaaatgttccatgagatgaacgagagtggaacaacggtggacatttccacatacgctataatacttggaggtttttgtagaaataattgtgcagacgaagctatcaccctattccacaaattaggtgcaatgaatgtgaagttcaatattgcaatagtcaataccatgatcaatgcaatgtacaaggttgggagaagagaagaagctaaggaactatttgctggaatattagcccgtgggttggtgcctaatgaatctacttacggagtaatgataaaaaatcttctaaaagatggagcagtggaagatgctaacaatgtgttttcatcaatggacaagagtggtatagtccccagctcccgtctcatcaatgacatcatcagattgttgttggaaaaaggtgagatcgccaaggccggatattatttgtctaaagttgatgggaagagcatatcacttgaagcttcaactacttcattgatgttttctctcttctcaaggaaaggcaaatataaggagaacatgaaattgctccctgccaagtatcaatttttcgatgtgttggttgac

SEQ ID NO: 2634 - DNA, 987 bp, Triticum aestivum; identical to SEQ ID NO: 2631

SEQ ID NO: 2635 - DNA, 987 bp, Triticum aestivum; identical to SEQ ID NO: 2631

SEQ ID NO: 2636 - DNA, 708 bp, Triticum aestivum
atggactgctgctgccgcgcacaccgcctcgatctggcgttcgctttcttcggccgtctcctcaggacgggacttaaggcaggcgtcattcaagtttgcactcttctcaagggcctctgccgcgcaaagcgggctgatgaggctctcgacgtgctgcttcacaggatgcctgagctggggggctgcacccccaacgtggtggcgtataccacggtcatccacggcttctttaaggaaggccaaataagcaaggcatgctatctattccatgaaatggcgctgcagggcgttacacctgatgtggtgacatatagctcggttattgatgcgctgtgcaaggccagagccatggacaaggcagagtatttccttcgtcagatggttcataatggtgtcctacctaataatgtgacatataatagcctcatccatggatattcctcttcaggccattggaaggaggcggttagggtgctgaaagaaatgacaagtcaaggtatcataccggatatcgtttcataccgtattctgcttcatgggtatgccaccgaagggtgcttagttgatatgattaatctcttcaattcaatggcaagatactgtattctacctgattgtcatatcttcaacatactgattaatgcatatgctaaatctgggaagcttgataaggctatgcttatatttaaagaatgcagaaacaaggag

SEQ ID NO: 2637 - DNA, 945 bp, Triticum aestivum
atggctcgcctctgctacaccacgcccatgccgcacctccgccgctgctgctcctcttccacctcgccgccttcacgccactgggacccccgacccgcctttgccgcggccacggagcgcgtccgcgccgggacgctcagccctgaagacgcacaccacctgtttgacgaattgctactgcaggccaaccccgtccccgagcgttccttcaacgacttccttgccgcgctcgcccgggctctgtcctccgctgctctcagagatggacactcccttgctctcggcatcttcaaccgtgtctgccgagaagaagcagggccgtgcgtgacgccacccacagtctgcacctacaacatcctcatggacagttgctgtcgtgcatgccacccgaacctaggccctgctttcttcggccgcttcctcaggacgggcctcaaggcagaccagatcgtcgccatcaacctcctcaagtgcctctgccacgcaaaacggaaggatgaggctgtcaacatgctgcttcataggatgtctgagttcggttgtgtgcctgatgccatctcatactccatagtacttaagagcttatgtgacgatagcaggagccagcaagcgctcgatctgctccagatggtaaggaaaggaggtgcctgctccctcgatgtggtggcatatagcacagtcatccgcagcttctttaaggagggtgaagtaagtaaggcatgcaatctattccatgaaatggtgcaacaagggattgtgcctaatgtggtgacatatagcttgattattgatgccttgtgcaaggtcagggcaatggacaaggcaaagctggtccttcagcagatggttgataatggtgttcgaccaaatatgtatacatgcatggaactcattcatgtactccctttgcaagaatggaggaagcaaagaagctgcagaattttt

SEQ ID NO: 2638 - DNA, 945 bp, Triticum aestivum; identical to SEQ ID NO: 2637

SEQ ID NO: 2639 - DNA, 945 bp, Triticum aestivum; identical to SEQ ID NO: 2637

SEQ ID NO: 2640 - DNA, 945 bp, Triticum aestivum; identical to SEQ ID NO: 2637

SEQ ID NO: 2641 - DNA, 945 bp, Triticum aestivum
atggctcgcctctgctacaccacgcccatgccgcacctccgccgctgctgctcctcttacacctcgccgccttcacgccactgggacccccgacccgcctttgccgcggccacggagcgcgtccgcgccgggacgctcagccctgaagacgcacaccacctgtttgacgaattgctactgcaggccaaccccgtccccgagcgttccttcaacgacttccttgccgcgctcgcccaggctctgtcctccgctgctctcagagatggacactcccttgctctcggcatcttcaaccgcgtctgccgagaagaagcagggccgtgcgtgacgccacccacagtctgcacctacaacatcctcatggacagttgctgtcgtgcatgccacccgaacctaggccctgctttcttcggccgcttcctcaggacgggcctcaaggcagaccagatcgtcgccatcaacctcctcaagtgcctctgccacgcaaaacggaaggatgaggctgtcaacatgctgcttcataggatgtctgagttcggttgtgtgcctgatgccatctcatactccatagtacttaagagcttatgtgacgatagcaggagccagcaagcgctcgatctgctccagatggtaaggaaaggaggtgcctgctccctcgatgtggtggcatatagcacagtcatccgcagcttctttaaggagggtgaagtaagtaaggcatgcaatctattccatgaaatggtgcaacaagggattgtgcctaatgtggtgacatataggttgattattgatgccttgtgcaaggtcagggcaatggacaaggcaaagctggtccttcagcagatggttgataatggtgttcgaccaaatatgtatacatgcatggaactcattcatgtaccccctttgcaagaatggaggaagcaaagaagctgcagaattttt

SEQ ID NO: 2642 - DNA, 945 bp, Triticum aestivum; identical to SEQ ID NO: 2637

SEQ ID NO: 2643 - DNA, 945 bp, Triticum aestivum; identical to SEQ ID NO: 2637

SEQ ID NO: 2644 - DNA, 1080 bp, Triticum aestivum
atgactgccaaaggccacagagctaatgttgtctcgtactgtattttgcttcatgggtatggcaatgaaggatgctttgctgatatgattgacctctttaattcaatggaaaggaatggcattgcagccgactgccgtgttttcaacatattaatcgatgcgtatgctaaacatggaatgacggatgaagctatgctcatatttacggaaatgcgggaaaaaggagcaggtcctgatgcgttcacctattccactgtaatagccgcactttccagaatgggtaggttgaccgatgctatgggcaagttcagtcagatgattgccatgggagttcaaccggacacaactgtttatcactccctgattcagggttgttgtttacatggtgatttggttaaagccaaggagctggtttgtgaaatgatgaacaaaggtattcctcgtcctagcattgtgttcttcaattcagtaataaacagtctgtgcaaagaaggaaggattatggatgcacacgatatctttgacttggttatagacataggtgagaggcctgatgccattacattcagttcactgattgacggatattgcttagtcggcaatatggataaagcattaaaagtacttgatgtcatggaatcagttggtgttgagcctaatgttattacatacaatacacttgttaatggctattgtagaaatggaaggatcgatgatagtttgactctgttcagagagatgccgcgtaagagaattaaacctgacactgtttcatattgcataataatgaatgggttgtttcgtgctgggagaactgttgccgcaagaaaaatgttccatgagatgacggaaaatggaataacagtgagtatttctacatacagtataatacttagaggtctttgtagaaataattgtgcagacgaagctatcaccctgttccagaaattaggaacaatgaatgtaaagtttgatattgcaatactcaataccatgattaatgcaatgtacaaaggttcaaagaaaggaagaagcaaaggaattgtttgctacaatatcagccaatgggttggtgcccaa

SEQ ID NO: 2645 - DNA, 1002 bp, Triticum aestivum
atggcaagtgttggtgttcaaccaaatgctgtcactttgaactcattaatcgattccctttgcaagcacagaaggacaaaggaagctagagaaatttttgactccatggccgcaaagggcctgaaacctaatatcgtctcctactctactatgcttaatgggtatgtcaaagaaggatgcttcgatgatatgactgatctcttcaattcgatggtacggaatggtatcgtacctaaccaccatattttcaacatactgatcaatgcatatgctaaacgtggagtgatggatgaggctatgcacatgttcgaagtaatgaggcaacaaggagtaaacccagatgtatttagctatcaaattgtaatggattcacttcgcaaaatgggcaggatggatgctgctctggacaaatttaatcagatggtcaatcaaggagtttcacctaacatagttgtttaccaatgcctggttctgggttcttgttctcatggtgattttgtgaaggccaaggaattgatttctgaagctgttaatagaggtctgtgttctaacagtgtgttcttctattctgtaataaatgacctgtgcaaagaaggaaaggtgaaggaggcacaggatatgtttcacttcattgtaggtattggtcagcggcctgatgtgattatgtacacttcactgatggatggatattgccttgttggcaaggtggaggaagcactgagagtacttggtgctatgaagtctgctggcctccaacctactgctgttacgtatggtatacttcttaatggctactgtaaaattggaaggatcgccgctggattgagtcttttcaaggaaatgtcactcagcggggttaagcccactactattttttttcgagaaaacgcaaaagagtttgcgtttcatttcattgaacaggaagagaacagcagtacaggtacaacctcccagaaggagggacacacgcacacacaccatcgtcctcaccagacaagcagg

SEQ ID NO: 2646 - DNA, 1143 bp, Triticum aestivum
atgctttttgcaaaaaagggtaggttggatgatgctgtgataaagtttaatcagatgattgatgcaggagtacgaccggacgcatctgtttatcgttccctaatccagggtttttgtacacatggcgatttggtgaaagcaaaggaatatgttactgaaatgatgaagaaaggtatgcttcctcctgatattatgttcttcagttcaatcatgcagaaactatgcacagaaggaagggtaatagaagcacgagatatccttgacttgatagtgcgcattggtatcaggcctgatgttttcatatttaatatactgatcggtggatactgcctagtccgcaagatggcagatgcatcaaaaatatttgatgatatggtgtcatatggtttagaaccttgtaatagtacgtatggtatacttattaatggctattgcaaaaacggaaggattgatgacgggctgattctgttcaaagaaatgttgcccaagggacttaaacctacaacttttaattacaacgtcatactggatggattatttctggctggacaaactgttgctgcaaaggagaagtttgatgagatggttgaatctggagtaagtgtgtgcatcgatacttactctatagttcttggtggactttgtagaaataattgtgccggtgaagcaatcacgctatttcagaaattaagcacaacgaatgtgaaattcgatattagaattgtcaatatcatgattgatgccttctaccgggttcggcgaaaccaggaagctaaggatttgtttgctgcagtatcagccaatggtttggtagctaatgtctttacctacaccgtaatgatgataaatcttatagaagaagggtcactggaagaagctgacactctctttttatcaatggagaggagcggctgtactgccaactcttatatgttaaatcatattatcagaaggttactggaaagaggagagatagtcaaggctggaaattatatgtcgaaagttgatgcaaagagctactcacttgaagctaaaactgtttcgctgctgatctccctctttttagggaaagggagatatagagaacacatgaaattgctccctatgaagtatcagtttctcgaagaagcagccacagttgaa

SEQ ID NO: 2647 - DNA, 1143 bp, Triticum aestivum; identical to SEQ ID NO: 2646

SEQ ID NO: 2648 - DNA, 1143 bp, Triticum aestivum; identical to SEQ ID NO: 2646

SEQ ID NO: 2649 - DNA, 1143 bp, Triticum aestivum; identical to SEQ ID NO: 2646

SEQ ID NO: 2650 - DNA, 999 bp, Triticum aestivum
atggttgatgaagtaatgcatatatttacaaaaatgcggcagcaaggactgaaccctgatgtagagaactatggagcggtagtaaacttgctttccaagattggccgaatggatgatgctatgtcccaattcaatcaaatgataactgaagggttagctcctgatgtcatagttttcaccccccttattagtggtttctgttcttgtggcaaatgggagaaggttgatgaactattttctgagatgttggatcgcggcatctgtcccgacacagtgttcttcaacactgttatggatcacctttgcaaaaatggaagggttatagaagcccaagatgtgttcgacctgatggtacacatgggtgtgaagcctgatgtgcgtagtcatgtcacactgatgcatggatactttgcagatggtaagatggatgaaatgaggaagttacttgaaaatatgtgctcaattggcttgaaacctgatgttgtcacctatagcatactgatagatagttactctaagaatggaaggatagatgatgcactggttgttttcagggaaatgttggacggtgttaagccttctattatcacttttaatattatgattggtgtgttgcttaaaggtagcaggaaggaagaagccaaagatttgtttgacggtatctgggccaaaggattagtgcctgacgttgttacatatagcttaatgatacaaaacttaatagaagaaggttctctacaagagtctgatgatctattcatttctatggagaagaatggatgtgctgccaactcctgtatgctgaatgctatagttagaagcttacttcagaaagaggagattcttagggctgggacttatctgtctaaaattgatgagaggaggttcacccttgaagcttccactgctagcttgttgactgcacttgtgtcagggggggaaggccaggaatataaggagttactccatgaaaaatactctgaactgctaatcgaggcc

SEQ ID NO: 2651 - DNA, 1125 bp, Triticum aestivum
atgaccgccaagggcctcaaacctgatattgtcgtgtactgtactcttcttcacgggtatgctaccgaaggatgcctcgccgatatgatcaatctctttaattcaatggaagacaatggtattgtagccaactgcaaagttttcaccatattaattgatggatatgctaaatgtggaatgatagatgaagctatgctcatctttaccaaaatgcgagaacaaggagtgagtcctaatgtattcacctatgcaattgtaacagctgcactttgcagaatgggcaggctgtctgatgcaatggacaaactaaatgagatgattgcaatgggcttacaaccgaacaaggttgtttatcgctctctaattcagggcttttgtacacatggtgatttggtgaaagcaaaggtcttggtttctgaaatgatgaacaaaggtattcctcgtccaaatatggtgttcttcaactcagtaataaacagtctatgcaaggaaggaagggttacagatgcacacgatatcttcgacttggctataaacattggtgagaggcctgacgttattacatttaattcactgattgacggacattgtttagccgggaagatggataaagcattcggagtacttgatgccatggtatcagctggcattgagcccaatgttgtcacatacaatacacttattgatggctattctagaaagggaaggattgatgatgggttgaccctattcagagaaatgatgcctaacaaaattaaacctacaactgctacatatggcgccatacttcatgggttgtttcgtgctggcagaacttctcctgcgaagaaaatgttcaatgagatgattgaaagtgaaacaacagtgaacatttccatatatgctataattcttggaggactttgtagaaacaattgcgttgatgaagcaattgtcttgttcgagaaattaggtgcaatgaatgtgaagttggatgttggaatattcaatactatgattaatgcaatgtacgcggttaagggaagagaagaagctaaggatttgtttgctgcaatatcagccaatgggctggtacctaatgcgtcttcttatggtgttatgataacaaatcttctaagagaggat

SEQ ID NO: 2652 - DNA, 1080 bp, Triticum aestivum
atgagccgccgctttgtccccgtcgacagacgcatcttggagcggaacatcaaggctcggtaccacgccggagacattggcacccaggacgcactccacctgttcgacgaattgatccaggttgctgggccttcctcggtccgtgccatcaactgcctcctcaccgtcgtcggccgtgattgccctgcgctcggtgtctccctcttcaaccgcgtcgcaagaaccaaggtgcctccccacaatgtcacctatggcattctagttgactgctgctgccgtgctggccgcctggaccttggacacgctgccatgggacgcgtcattaagttgggatttacagcagaagctatcgtcaatttcagccacctactcaaggccatctgtgcagagaagaagaccagttatgcaatggacatcgtactccggataatgcccgagtttaactgcatgccaaacattttctcgtataacattcttttcaagggtctctgcaacgagaagagaagccaagaggctctcgacctgattcaaattatggttgaggatggaggttgctgccgacctgatgtggtgacctatagcactgtaattgatggcttgttgaaagagggtgaggtaggcaaggcttacaggctattttctgaaatgctacagagggggatttcgccaaatgctgtgacctatagctcaatcatctgtggcatgtgcaggcttcatctgatggacaaggctgaggaggttcttcaacagatgtttgatagagaaattctgccagatgttgctacatatactagtctaatacatggatattattcattaggacagtgcgaggaggtggatcggattttcaaagaaatgtctagaaatggtgttcaaccagatatcgtaacttataacatacagatggattatctttgcaagaatggaagatgcgcagaagctaggaagatttttgattccatggtcagtttgggccaaaaaccgactgttactacctacagcattctgcttcatgggtatgctatagaaagatttttgattccatgcccgggcgtcgacccgttggttgggcagctgggt

SEQ ID NO: 2653 - DNA, 1026 bp, Triticum aestivum
atgtcccgcatccacctccaccgctgcctctactcctccacctcgcggcccttgcgttcctggtctccccgcgccgcctttgccgcggcaacagagcgcgtccgcgctggggcgctcagccaagacgatgcacaccacctgttcgacgaattgctgcggcaggccaccccggtccccgggcgctccctcaacggcttccttgccgccctcgcccgtgcgccggcctccgaagtctgcagagatgggcccgccctcgccctcgccctcttcaatcgcgtctgtcgtgatgaagccggcgcgcctctcacagtccacacctacggcatcctcatgggctgctgctgccgtgggcatcgcccggacctagggcttgccttattcggtcgcctccacaggacgggcatcaagacaaaccagatcgccgtcaacaccttccttaagtgcctctgttacgcaaaacggacggatgaagctgtgaacgtgctgcttcataggatgtccgagctcggctgtgtgcctaatgccttctcatactccattgttctgaagagcttatgctacaatagcatgagtcagcgggcgctcgacctgctccagatgatggcgaaagaaggaggtgcctgctcccccaacgtggtgacatataccacggtcatccatggcctctttaaggaaggcgaaacaggcaaggcatgcaatctattccatgaaatgaagcagcaagggattgagcccaatgtggtgacatatacctcgagcattgatgcgttgtgcaaggccagagcaatggacaaggcagagctagtccttcggcagatggttgctaatggtgctcaacccaatgaagtgacatataattgcatgatccatggatattccacatcagggcagttgaaagaggctgctaaaatgttcagagaaatgacaagtcagggtcttataccagataactttacttgcagctcgttaatgacttccctttgcaagcatcaaagaagcaaagaagctgcagaaatttttatgcca

SEQ ID NO: 2654 - DNA, 1122 bp, Triticum aestivum
atgggtaggatggatgctgctctggacaaatttaatcagatggtcaatcaaggagtttcacctaacaaagctgtttaccaatgcctggttctgggttcttgttctcatggtcattttgtgaaagccaaggaattgatttctgaagcagttaatagaggtctgtgttctaacagtgtgttcttctatcctgtaataaacgacctgtgcaaagaaggaaaggtgaaggaggcacaggatatgtttgacttcattgtaggtattggtcagcggcctgatgtgattatgtacaattcactgatggatggatattgccttgttggcaaagtggaggaagcactgagagtacttgatgctatgaagtctgctggcctccaacctactgctgttacgtatggtatacttcttaatggctactgtaaaattggaaggattgccgctggattgagtcttttcatggaaatgtcactcagcggggttaagcccactactattatgtacaacattatacttgatgggctgtttcgctccgggagaacagattctgcaaaggaaaaattccgtacgatgagcgaaagtggcataccagtgggcattgacacatacaacatagttcttagtggactttgtaaaaataattgcgctggtgaagcaatagagctgttcaagaaactacgtgcaatgaatgtgaagattgatgtcaaaacactcactatcatgatttctgcaatgtttaaaagtaggagaattgaagaagccaaggagttgtttgctactatatcagccatcgggttggtgccttctgttgtgacttacagtgtaatgatgacgaatttcataaaagaagggtcgctggcagagactgatgatatgtttttagcaatggagaaggctagctgtgctcccgactccatcctgctaaatcaagtggtcagggcgttgctggaaaaaggtgcagttgtaaaggctgcaacttatctcgctaaacttgatgctaaacagctgtcagttgaagcttcaacgatttcgttaatagtatctctcttctcaggggaagggaaactaagggagcacgtagagttgcttccagtaaagtaccagcctcctgagagttcgactgacaat

SEQ ID NO: 2655 - DNA, 885 bp, Triticum aestivum
atgtttgacttcattgtaggtattggtcagcggcctgatgtgattatgtacaattcactgatggatggatattgccttgttggcaaagtggaggaagcactgagagtacttgatgctatgaagtctgctggcctccaacctactgctgttacgtatggtatacttcttaatggctactgtaaaattggaaggattgccgctggattgagtcttttcatggaaatgtcactcagcggggttaagcccactactattatgtacaacattatacttgatgggctgtttcgctccgggaggacagattctgcaaaggaaaaattccgtacgatgagcgaaagtggcataccagtgggcattgacacatacaacatagttcttagtggactttgtaaaaataattgcgctggtgaagcaatagagctgttcaagaaactacgtgcaatgaatgtgaagattgatgtcaaaacactcactatcatgatttctgcaatgtttaaaagtaggagaattgaagaagccaaggagttgtttgctactatatcagccatcgggttggtgccttctgttgtgacttacagtgtaatgatgacgaatttcataaaagaagggtcgctggcagagactgatgatatgtttttagcaatggagaaggctagctgtgctcccgactccatcctgctaaatcaagtggtcagggcgttgctggaaaaaggtgcagttgtaaaggctgcaacttatctcgctaaacttgatgctaaacagctgtcagttgaagcttcaacgatttcgttaatagtatctctcttctcaggggaagggaaactaagggagcacgtagagttgcttccagtaaagtaccagcctcctgagagttcgactgacaat

SEQ ID NO: 2656 - DNA, 1122 bp, Triticum aestivum; identical to SEQ ID NO: 2654

SEQ ID NO: 2657 - DNA, 1110 bp, Triticum aestivum
atgataagtcttggtgttgtaccaaatgctatcatgtggaactcatttatggattcactttgcaagcatagaaggacaaaggaagctagagacatttttgactccatggctgcaaagggccaaaaacctgatattttctcctattctactatgcttaacgggtatgcgaaagaaggatgctttgatgatatgacttgtctcttgaatttgatgctacagaatggtgttgtacctaaccaccatattttcaacatactgatcaatgcatatgctaaacctggactgatggatgaggctatgcacatgtttgaagtaatgaggcaacaaggagtaaacccggatgtatttgactatcaaatcataatggattcactttataaaatgggtaggatggatgctactctggacaaatttaatcagatggtcaatcaaggagtttcacctaacaaagctgtttaccaatgcctggttctgggttcttgttttcatggtcattttctaaaagccaaggaattgatttctgaagcagttaatagaggtatgtgttctaacagcatgttcttctatcctgtaataaacgacctgtgcaaaggaaaggtagaggaggcacaggatatttttgacttcattttaggtattggtcagcggcctgatgtgactatgtacaattcactgatggatggatattgccttgttggcaaggtggaggaagcactgagagtacttgatgctatgaagtctgctggcctccaacctgatgctattacgtatgctatacttcttaatggctactgtaaaattggcaagatcaccgacggattgagtcttttcagggaaatgtcactcagcggggtaaagcccacaactattatgtacaacattatacttgacgggctgttttgctccgggagaacagtttctgcaaaggaaaaattcaatacgatggttgaaagtggcttaccagtggacgtttgcacatacaacatagttctctgtggactttataaaaacaattgcactggtgaagcaatagagttgttcaagaaactacgtgctataaacatgaagattgatgtcataatactcaataccataatttctttaattttt

SEQ ID NO: 2658 - DNA, 1053 bp, Triticum aestivum
atggaaaaatcttttcatgatatgcattgtctcattgatttgatggtagaaaatggtattgcaccagatcatcatgtctacaacatactcatatctgcatgtgctcaagaagaaatggttagtgacgtaatgcatatatttacaaaaatgcggcagcaaggattgaaccctaatgtagcgaactatggagtggttgtaaacttgctttgcagcatgggccgaatggatgatgctatgtaccaatacaatcaaatgataaccgaaggattagatcctgatatcatagttttcagcacccttataagtggtttttgttcttgtggcgcatgggagagggttcatgaaatattttctgaaatgttgaatcgtggcatctatcctgataccgtgttcttcaacataattatggaccacctttgcaaagagggaagggttatggaagcccaggatatcttcgacctgatggtacacatgggtgtgaagccttttgtccgtgattacaacacactgatacatggatactgtttagttggtaagatggacgaagggaggaagttacttgacaatatgtgctcaattggcttgaaaccggatgatttcacctatagcatactgattgatggttactctatgaagggaaggatagatgatgcattgattgttgtcagggaattgttggacgggaaggttggaccttctattatcacttttaatattatgattgttgcgttgcttaaaggtgggagaaaggaagaagccaaagatttgtttgatggtatctgggccaaaggattagtgcccgatgttgttacatatagcttaatgatacaaaaacttatagaagaaggttctctacaagagtctgatgatctattcctttctatggagaagaatggatgtgctgccgattcccgcatgctaaatgatatagttagaagcttacttcagaaagggacaatgcaagtatcaatggagtatgcaacggaggcaagcctagcaaggttgccattcaaaatatatcatgcactcagggaagcaacgaaaatgccatca

SEQ ID NO: 2659 - DNA, 675 bp, Triticum aestivum
atgatgagcaaaggtattcctcgtcccaacattgtgttcttcaattcagttataaactatttatgcaaagaaggaagggttatggatgcacaagatatctttgaatttattataagcatagatgagagacctgatgtcattacatttaactcgctgattgacggatattgcttagtcagcaagatggataaagcatctggagtacttgatgccatggtatcagctggcattgagcctaatgttgttacatataatacacttgttagtggctattctataaatagaaggatcgatgatggtttgactctgtttaggcaaatgccacttaagagaataaaacctgacagtgttacatatggcatcatactggatgggttttttcgtgctgggagaactgttgctgcaaggaaaatgttccatgagatgatcgaaaggggtataccagtgaccatttccatatacaatagaatacttggaggtctctgtagaaataattgtgcagacgaagccatcgcactattccagaaattaggagcaatgaatgtgaagttcgatattataacacttaataccatgattaatgcatgttcaaggttcgaagaagagaagaagctaacgatttgtttgctgcaatatcagccagtgggttggtgcctaatgcttctacttacggca

SEQ ID NO: 2660 - DNA, 975 bp, Triticum aestivum
atgatgagcaaaggtattcctcgtcccaacattgtgttcttcaattcagttataaactatttatgcaaagaaggaagggttatggatgcacaagatatctttgaatttattataagcatagatgagagacctgatgtcattacatttaactcgctgattgacggatattgcttagtcagcaagatggataaagcatctggagtacttgatgccatggtatcagctggcattgagcctaatgttgttacatataatacacttgttagtggctattctataaatagaaggatcgatgatggtttgactctgtttaggcaaatgccacttaagagaataaaacctgacagtgttacatatggcatcatactggatgggttttttcgtgctgggagaactgttgctgcaaggaaaatgttccatgagatgatcgaaaggggtataccagtgaccatttccatatacaatagaatacttggagatctttgtagaaataattgtgcagacgaagccatcgcactattccagaaattaggagcaatgaatgtgaagttcgatattataacactcaataccatgattaatgcaatgttcaaggttcgaagaagagaagaagctaacgatttgtttgctgcaatatcagccagtgggttggtgcctaatgcttctacttacggcataatgataaaaaatattctaaaggaaggatcagtggaagaaattgacaatatgttttcatcaatggagaagagtggtatagttcccagctctcatcttataaatgatattataagaatgttgttggaaaaaggtgagattgccagggccggatattatttgttgaaagttgatgggaagaacaccttgcttgaagcttcaactacttcactgatgttgtccctcttttctagggaagggaaatatcaggaggacgtgaaattgctccctgcaaagtatcaatttttctatggatttggt

SEQ ID NO: 2661 - DNA, 975 bp, Triticum aestivum; identical to SEQ ID NO: 2660

SEQ ID NO: 2662 - DNA, 675 bp, Triticum aestivum; identical to SEQ ID NO: 2659

SEQ ID NO: 2663 - DNA, 975 bp, Triticum aestivum; identical to SEQ ID NO: 2660

SEQ ID NO: 2664 - DNA, 975 bp, Triticum aestivum; identical to SEQ ID NO: 2660

SEQ ID NO: 2665 - DNA, 1074 bp, Triticum aestivum
atgataatggtatttcaccagatcattatggctacaacatactcatatctgcttatgctaaagaaaaaaatggttgatgatgtattgcatatatttacaaaaatgcggcagcaaggattgaaccctgatgttgcgaactatggagcggtaataaacttgctttctagtattggccgaatggatgatgctatgtcccaatacaatcaaatgataaatgaagggttagctcctgatatcatagttttcaactcccttattagtggtttctgttcttgtggcaaatgggagaaggttcatgaactattttctgagatgttggatcgcggcatctgtcccaacacagtgttcttcaccactattatggaccgcctttgcaaaaatggaagggttatggaagcccaagatctcttcgacctgatggtacacatgggtgtgaagcctgatgtgtggacttataacacactgataggtggatacttgttcattggtaagatggatgaagtgagcaagttacttgacaatatgtgctcaattggcttgaaaccaaatgttttcacctatggcatactgatcgatggttactctaagaatggaagtatagatgatgcactggttgttatcagggaaatgttggacggtgttaagccttctattatcacttttaatattatgattggtgtgttgcttaaaggtagcaggatggaagaagccaaagatttgtttgacggtatctgggccaaaggattagtgcctgacgttgttacatatagcttaatgatacaaaaactaatagaagaaggttctctacaagagtctgatgatctattcgtttctatggagaagaatggctgtgctgccgactcctgtatgctaaatgctatagttagaaggttacttcagaaaggggagattcttatggctgggacttatctgtctaaaattgatgagagaagattcagctttgaagcttccacagctagcttgttggctgcacttgtgtcaggggggaaaggccaggaatataaggagttactccccgaaaaataccactattttctggaacagggcactgat

SEQ ID NO: 2666 - DNA, 1074 bp, Triticum aestivum; identical to SEQ ID NO: 2665

SEQ ID NO: 2667 - DNA, 1032 bp, Triticum aestivum
atggcaaaaggagatgattgctccccctgtgtgctgtcatatagcacggtcatccatggcttctttaaggaaggggaagtaggcatggcatgcaatctattccatgaaatgacccagcaaggggttgtgcctaatgtggtgacatataactcgattatcgatgcaatgtgcaaggcaggagcaatggacaagacggagctggtccttcggcaaatggttgataatggtgtccgaccggataaagtaatatataatagtatgatccatggatattcaactttgggccggtggaaagaggcgggtaaaatgttcagagaaatgacaagccggggtcttataccagatattttcacttggaactcgttcatgggctccctttgcaagcatggaagaagcaaagaagctgcagaaattttcttttccatggccgcaaagggctacaaaactaatattgtctcctacattgctcttcttcgtgtgtatgccaatgaaggaagctttgctgatatgatgagtctatttaattcaatggaaggcaacggtattgtagccaactgccaagttttcaccatattaattgatgcatatgctaaacaaggaatgattgatgaagctatgctcatacttactgacatgcggggacaaggactgagtccggatgtattcacctattcaactctaatatctgcactttgcagaatgggtaggctggctgatgctatggataagttcagtcagatgattggcatgggagtacaaccgaacacagttgtttatcactccctagttcagggcttatgtacacatggtgatttggcgaaagcggaggagttagtttctgaaatgatgaataaaggtattgctcgtccaaacaaatcgttagcttcttcctttttgtatcattactccataagtggaagcattaggcgggttggtgccaaccctgcgtatatccgtgtatctatttgccagcatatatccgtgtgtgacaaccctgcggagacaatccgttgcagttgtcatccttctttt

SEQ ID NO: 2668 - DNA, 975 bp, Triticum aestivum
atgatgaacaaaggtattcctcgtcctagcattgtgttcttcaattcagtaataaacagtctgtgcaaagaaggaaggattatggatgcacacgatatctttgacttggttatagacataggtgagaggcctgatgccattacattcagttcactgattgacggatattgcttagtcggcaatatggataaagcattaaaagtacttgatgtcatggaatcagttggtgttgagcctaatgttattacatacaatacacttgttaatggctattgtagaaatggaaggatcgatgatagtttgactctgttcagagagatgccgcgtaagagaattaaacctgacactgtttcatattgcataataatgaatgggttgtttcgtgctgggagaactgttgccgcaagaaaaatgttccatgagatgacggaaaatggaataacagtgagtatttctacatacagtataatacttagaggtctttgtagaaataattgtgcagacgaagctatcaccctgttccagaaattaggaacaatgaatgtaaagtttgatattgcaatactcaataccatgattaatgcaatgtacaaggttgggagaagagaagaagctaaggatttgtttgctgcaatatcacacagtggcttggtgcccaatgaatctacttataaggtaatgataaaaaatcttctaaaagacggagcagtggaagatgctgacaatatgttttcatcaatggacaacagtggtatcgttcccagttcccttcttataaatgatatcatcagaatgttgttggaaaaaggtgagatagccaaggctggaaattatttgtctaaagttgatgggaagagtatctcacttgaagcttcaactgcctcattgatgttgtctctcttttcaaggaaagggaaacatcaggaggatattaagttgctccctgcaaagtatcaatttttcgatgggtttggt

SEQ ID NO: 2669 - DNA, 975 bp, Triticum aestivum; identical to SEQ ID NO: 2668

SEQ ID NO: 2670 - DNA, 975 bp, Triticum aestivum; identical to SEQ ID NO: 2668

SEQ ID NO: 2671 - DNA, 975 bp, Triticum aestivum; identical to SEQ ID NO: 2668

SEQ ID NO: 2672 - DNA, 975 bp, Triticum aestivum; identical to SEQ ID NO: 2668

SEQ ID NO: 2673 - DNA, 975 bp, Triticum aestivum; identical to SEQ ID NO: 2668

SEQ ID NO: 2674 - DNA, 759 bp, Triticum aestivum
atgattattgtacacatggtgattgtacacatggttaaaaaaactctaattcagggttattgtacacatggtgatttggtgaaagcaatgggattggtttctgaaatgattaacagaggtattcctcctccagacattgtgttctttaattcagtaataaatagtctatgcaaagaaggaagggttacagatgcacaagatacctttgacttggttatatactttggtgagaggcccgacatctttacatttaactcgctgattgacggatattgcttagttggtgagatggagaaggctttcggagtacttgataccatggcatcaggtgggattgagcctgatagtatttcatataatacaattgttaatggatattttaaaaatgataggattgatgatggattggccttattccgagaaatgctgaagaaagttaaacctacaactgttacatataacatcatactggatgggttatttggtgctgggaaaacagttgctgcgaagaaaacgttccatgagatgatcgaaagtggaataacagtgagcatatccacatacaggataatccttggtggactttgcaggaatagttgtgatgatgaagcgatcaccctgttccagaaattaggagcaatgaatgtcaagttggatattacaatactcaataccatgatcaatgcactgttcaaggttcagagaagagaagaagctaacaatttgtttgctacagtatcagccagtgttgattgtttt

SEQ ID NO: 2675 - DNA, 990 bp, Triticum aestivum
atgagattggtttctgaaatgattaacagaggtattcctcctccagacattgtgttctttaattcagtaataaatagtctatgcaaagaaggaagggttacagatgcacaagatatctttgacttggttacatactttggtgagaggcccgacatctttacatttaactcgctgattgacggatattgcttagttggtgagatggagaaggctttcggagtacttgataccatggcatcaggtgggattgagcctgatagtatttcatataatacaattgttaatggatattttaaaaatgataggattgatgatggattggccttattccgagaaatgctgaagaaagttaaacctacaactgttacatataacatcatactggatgggttatttggtgctgggaaaacagttgctgcgaagaaaacgttccatgagatgatcgaaagtggaataacagtgagcatttccacatacaggataatccttggtggactttgcaggaatagttgtgatgatgaagcgatcaccctgttccagaaattaggagcaatgaatgtcaagttggatattacaatactcaataccatgatcaatgcactgttcaaggttcagagaagagaagaagctaacaatttgtttgctgcagtatcagccagtggattggtacctaatgcttatacctattgcataatgataacaaatctaataaaagaaggatcagtggaagaagctgaaaatatgttcttattaatggagaagagcagttgtgctccggactctcgtcttataaactgtatcatcagaatattattggaaaaaggtgagattgtcaaggctggaaattatatgtctaaagttgatggcaagagcatctcacttgaagcttcaactacttcgttgttgatacatctctttgcaagtaaagggaaatatcaggaacagataaatttactccctgtaaagtaccgatttttcgaaggagtcagt

SEQ ID NO: 2676 - DNA, 990 bp, Triticum aestivum; identical to SEQ ID NO: 2675

SEQ ID NO: 2677 - DNA, 990 bp, Triticum aestivum; identical to SEQ ID NO: 2675

SEQ ID NO: 2678 - DNA, 759 bp, Triticum aestivum; identical to SEQ ID NO: 2674

SEQ ID NO: 2679 - DNA, 990 bp, Triticum aestivum; identical to SEQ ID NO: 2675

SEQ ID NO: 2680 - DNA, 972 bp, Triticum aestivum
atgatgaacagaggtattcctcgtccaaacattgtgttcaattcagtaataaacagtctgtgcaaagaaggaagggttatggatgcacatgatgtcttagacttggttataggcataggtgagaggcctaatgtcattacatttaattcactgattgacggatattgcttagtcgggaacatggataaagcattcaaaatacttgatgtcatggaatcagttggtgttgagcctaatgttgttacttatagtgcacttcttgatggctattctaaaaacagaaggattgatgatgctctgactttgtttagagaaatgccgcgtaagagaattaagcctgacactgttacatatggcatcatgttggatgggttgtttcgtgccgggagaactgtcgctgcaatggaaatgttccatgagatgactgaaagtggaacaacagtggacattgtcatatacaatataatacttggaggtctttgtagaaataattgtgtagatgaagcgattgcactgttccagaaattgcgagcaatgaatgtgaagttcaatattgaaatactcaataccatgattaatgcaatgtacaaggttcaaagaaaggaagaagcaaaggaattgtttgctacaatatcagccaatgggttggtgcccaatgaatctacttatgcagtaatgataagaaatcttctaagaggcggagcagtggaagatgctgacaatatgttttcatcaatggacaacagtggcatcgttcccagttccggtcttataaatgatatcatcagaatgttgttgaaaaaaggtgagatagccaaggctggcaattatttgtctaaagttgacgggaagagtatctcacttgaagcttcaactaccgcattgttgttgtctctcttttcaaggaaagggaaacatcaggtggatattaagttgctccctgcaaagtatcaattttttgatggatttggt

SEQ ID NO: 2681 - DNA, 1038 bp, Triticum aestivum
atgccgcgccttcaggtccgctctttctgcagctccttctcctcacgcgcctacgacctgctgaacgaactccaaggccatctggactccaggacgctcagaccagagctcgcgcgccaactgttcgacgaaatgctgcgccaaccagtcccagtaacggcgcgtgcactcaacggcttatttgctgcgctcgcgcgtgcgccgccttcaaccgcctgcactgatggccctgcgctcgccgtcgatctcttcaaccatatggcccgagcaggccgccgccggatgacaggacccaccgttcacacttacaacatactaattgactgctgccaccgagcatgccgcccagacctagggcctgccttctttggctgcctcctcaagacaggcatcacaatgagcgccattacctacagcagcctattcaagttcctctgtgacatgaggcgcacaaaggaggctctgaacgtgctgctccataggatgcccgatgacctgcctaatgtcatctcctactcagtgattctcaagagtttctgcgacagtgggaggagccagcttgcgcttgacctgctccgggtgatggccaaaaaaggtggtgaccactctcccgacgtgatggcatacaacatggtaatggatggcttgtttaaggagggtgaagtaagcaaagcatgtgatctattccacgaaatgatacaacagggggttgtgcctaatgaggtgacatatagctccataatcaatgcgctatgcaaagcaagagcaatggataaggcagaggtgatccttcgacacatggttcgtaatggtgtccaaccacatgatagtaggatatataataccctgatccatggatttttaacttcggatcagctgaaagaagcctttaggttgttgaaagtaatgagaagccatggtagtatgccaaacgttgttacttgcacctcagtcatggactacctttgcaagcatggaagaatcaaagaagctgaggaaatattttattccatggccgtgaatggccgaaaccaaata

SEQ ID NO: 2682 - DNA, 1035 bp, Triticum aestivum
atgccgcgccttcaggtccgctctttctgcagctccttctcctcacgcgcctacgacctgctgaacgaactccaaggccatctggactccaggacgctcagaccagagctcgcgcgccaactgttcgacgaaatgctgcgccaaccagtcccagtaacggcgcgtgcactcaacggcttatttgctgcgctcgcgcgtgcgccgccttcaaccgcctgcactgatggccctgcgctcgccgtcgatctcttcaaccatatggcccgagcaggccgccgccggatgacaggacccaccgttcacacttacaacatactaattgactgctgccaccgagcatgccgcccagacctagggcctgccttctttggctgcctcctcaagacaggcatcacaatgagcgccattacctacagcagcctattcaagttcctctgtgacatgaggcgcacaaaggaggctctgaacgtgctgctccataggatgcccgatgacctgcctaatgtcatctcctactcagtgattctcaagagtttctgcgacagtgggaggagccagcttgcgcttgaccttctccgggtgatggccaaaaaaggtggtgaccactctcctgacgtgatggcatacaacatggtaatggatggcttgtttaaggagggtgaagtaagcaaagcatgtgatctattccacgaaatgatacaacagggggttgtgcctaatgaggtgacatatagctccataatcaatgcgctatgcaaagcaagagcaatggataaggcagaggtgatccttcgacacatggttcgtaatggtgtccaaccacatgataggatatataataccctgatccatggatttttaacttcggatcagctgaaagaagcctttaggttgttgaaagtaatgagaagccaaggtagtatgccaaacgttgttacttgcacctcagtcatggactacctttgcaagcatggaagaatcaaagaagctgaggaaatattttattccatggccgtgaatggccgaaaccaaata

SEQ ID NO: 2683 - DNA, 1035 bp, Triticum aestivum
atgccgcgccttcaggtccgctctttctgcagctccttctcctcacgcgcctacgacctgctgaacgaactccaaggccatctggactccaggacgctcagaccagagctcgcgcgccaactgttcgacgaaatgctgcgccaaccagtcccagtatcggcgcgtgcactcaacggcttatttgctgcactcgcgcgtgcgccgccttcaaccgcctgcactgatggccctgcgctcgcggtcgatctcttcaaccatatggcccgagcaggccgccgccggatgacaggacccaccgttcacacttacaacatactaattgactgctgccaccgagcatgccgcccagacctagggcctgccttctttggctgcctcctcaagacaggcatcacaatgagcgccattacctacagcagcctattcaagttcctctgtgacatgaggcgcacaaaggaggctctgaacgtgctgctccataggatgcccgatgacctgcctaatgtcatctcctactcagtgattctcaagagtttctgcgacagtgggaggagccagcttgcgcttgacctgctccgggtgatggccaaaaaaggtggtgaccactctcccgacgtgatggcatacaacatggtaatggatggcttgtttaaggagggtgaagtaagcaaagcatgtgatctattccacgaaatgatacaacagggggttgtgcctaatgaggtgacatatagctccataatcaatgcgctatgcaaagcaagagcaatggataaggcagaggtgatccttcgacacatggttcgtaatggtgtccaaccacatgataggatatataataccctgatccatggatttttaacttcggatcagctgaaagaagcctttaggttgttgaaagtaatgagaagccaaggtagtatgccaaacgttgttacttgcacctcagtcatggactacctttgcaagcatggaagaatcaaagaagctgaggaaatattttattccatggccgtgaatggccgaaaccaaata

SEQ ID NO: 2684 - DNA, 1035 bp, Triticum aestivum
atgccgcgccttcaggtccgctctttctgcagctccttctcctcacgcgcctacgacctgctgaacgaactccaaggccatctggactccaggacgctcagaccagagctcgcgcgccaactgttcgacgaaatgctgcgccaaccagtcccagtaacggcgcgtgcactcaacggcttatttgctgcgctcgcgcgtgcgccgccttcaaccgcctgcactgatggccctgcgctcgccgtcgatctcttcaaccatatggcccgagcaggccgccgccggatgacaggacccaccgttcacacttacaacatactaattgactgctgccaccgagcatgccgcccagacctagggcctgccttctttggctgcctcctcaagacaggcatcacaatgagcgccattacctacagcagcctattcaagttcctctgtgacatgaggcgcacaaaggaggctctgaacgtgctgctccataggatgcccgatgacctgcctaatgtcatctcctactcagtgattctcaagagtttctgcgacagtgggaggagccagcttgcgcttgaccttctccgggtgatggccaaaaaaggtggtgaccactctcccgacgtgatggcatacaacatggtaatggatggcttgtttaaggagggtgaagtaagcaaagcatgtgatctattccacgaaatgatacaacagggggttgtgcctaatgaggtgacatatagctccataatcaatgcgctatgcaaagcaagagcaatggataaggcagaggtgatccttcgacacatggttcgtaatggtgtccaaccacatgataggatatataataccctgatccatggatttttaacttcggatcagctgaaagaagcctttaggttgttgaaagtaatgagaagccaaggtagtatgccaaacgttgttacttgcacctcagtcatggactacctttgcaagcatggaagaatcaaagaagctgaggaaatattttattccatggccgtgaatggccgaaaccaaata

SEQ ID NO: 2685 - DNA, 1035 bp, Triticum aestivum; identical to SEQ ID NO: 2683

SEQ ID NO: 2686 - DNA, 903 bp, Triticum aestivum
atgctgcgccaaccagtcccagtatcggcgcgtgcactcaacggcttatttgctgcactcgcgcgtgcgccgccttcaaccgcctgcactgatggccctgcgctcgccgtcgatctcttcaaccatatggcccgagcaggccgccgccggatgacaggacccaccgttcacacttacaacatactaattgactgctgccaccgagcatgccgcccagacctagggcctgccttctttggctgcctcctcaagacaggcatcacaatgagcgccattacctacagcagcctattcaagttcctctgtgacatgaggcgcacaaaggaggctctgaacgtgctgctccataggatgcccgatgacctgcctaatgtcatctcctactcagtgattctcaagagtttctgcgacagtgggaggagccagcttgcgcttgaccttctccgggtgatggccaaaaaaggtggtgaccactctcccgacgtgatggcatacaacatggtaatggatggcttgtttaaggagggtgaagtaagcaaagcatgtgatctattccacgaaatgatacaacagggggttgtgcctaatgaggtgacatatagctccataatcaatgcgctatgcaaagcaagagcaatggataaggcagaggtgatccttcgacacatggttcgtaatggtgtccaaccacatgataggatatataataccctgatccatggatttttaacttcggatcagctgaaagaagcctttaggttgttgaaagtaatgagaagccaaggtagtatgccaaacgttgttacttgcacctcagtcatggactacctttgcaagcatggaagaatcaaagaagctgaggaaatattttattccatggccgtgaatggccgaaaccaaata

SEQ ID NO: 2687 - DNA, 1035 bp, Triticum aestivum
atgccgcgccttcaggtccgctctttctgcagctccttctcctcacgcgcctacgacctgctgaacgaactccaaggccatctggactccaggacgctcagaccagagctcgcgcgccaactgttcgacgaaatgctgcgccaaccagtcccagtatcggcgcgtgcactcaacggcttatttgctgcactcgcgcgtgcgccgccttcaaccgcctgcactgatggccctgcgctcgccgtcgatctcttcaaccatatggcccgagcaggccgccgccggatgacaggacccaccgttcacacttacaacatactaattgactgctgccaccgagcatgccgcccagacctagggcctgccttctttggctgcctcctcaagacaggcatcacaatgagcgccattacctacagcagcctattcaagttcctctgtgacatgaggcgcacaaaggaggctctgaacgtgctgctccataggatgcccgatgacctgcctaatgtcatctcctactcagtgattctcaagagtttctgcgacagtgggaggagccagcttgcgcttgaccttctccgggtgatggccaaaaaaggtggtgaccactctcctgacgtgatggcatacaacatggtaatggatggcttgtttaaggagggtgaagtaagcaaagcatgtgatctattccacgaaatgatacaacagggggttgtgcctaatgaggtgacatatagctccataatcaatgcgctatgcaaagcaagagcaatggataaggcagaggtgatccttcgacacatggttcgtaatggtgtccaaccacatgataggatatataataccctgatccatggatttttaacttcggatcagctgaaagaagcctttaggttgttgaaagtaatgagaagccaaggtagtatgccaaacgttgttacttgcacctcagtcatggactacctttgcaagcatggaagaatcaaagaagctgaggaaatattttattccatggccgtgaatggccgaaaccaaata

SEQ ID NO: 2688 - DNA, 1038 bp, Triticum aestivum
atgccgcgccttcaggtccgctctttctgcagctccttctcctcacgcgcctacgacctgctgaacgaactccaaggccatctggactccaggacgctcagaccagagctcgcgcgccaactgttcgacgaaatgctgcgccaaccagtcccagtatcggcgcgtgcactcaacggcttatttgctgcactcgcgcgtgcgccgccttcaaccgcctgcactgatggccctgcgctcgccgtcgatctcttcaaccatatggcccgagcaggccgccgccggatgacaggacccaccgttcacacttacaacatactaattgactgctgccaccgagcatgccgcccagacctagggcctgccttctttggctgcctcctcaagacaggcatcacaatgagcgccattacctacagcagcctattcaagttcctctgtgacatgaggcgcacaaaggaggctctgaacgtgctgctccataggatgcccgatgacctgcctaatgtcatctcctactcagtgattctcaagagtttctgcgacagtgggaggagccagcttgcgcttgacctgctccgggtgatggccaaaaaaggtggtgaccactctcccgacgtgatggcatacaacatggtaatggatggcttgtttaaggagggtgaagtaagcaaagcatgtgatctattccacgaaatgatacaacagggggttgtgcctaatgaggtgacatatagctccataatcaatgcgctatgcaaagcaagagcaatggataaggcagaggtgatccttcgacacatggttcgtaatggtgtccaaccacatgatagtaggatatataataccctgatccatggatttttaacttcggatcagctgaaagaagcctttaggttgttgaaagtaatgagaagccatggtagtatgccaaacgttgttacttgcacctcagtcatggactacctttgcaagcatggaagaatcaaagaagctgaggaaatattttattccatggccgtgaatggccgaaaccaaata

SEQ ID NO: 2689 - DNA, 1038 bp, Triticum aestivum; identical to SEQ ID NO: 2688

SEQ ID NO: 2690 - DNA, 639 bp, Triticum aestivum
atgagcgccattacctacagcagcctattcaagttcctctgtgacatgaggcgcacaaaggaggctctgaacgtgctgctccataggatgcccgatgacctgcctaatgtcatctcctactcagtgattctcaagagtttctgcgacagtgggaggagccagcttgcgcttgaccttctccgggtgatggccaaaaaaggtggtgaccactctcccgacgtgatggcatacaacatggtaatggatggcttgtttaaggagggtgaagtaagcaaagcatgtgatctattccacgaaatgatacaacagggggttgtgcctaatgaggtgacatatagctccataatcaatgcgctatgcaaagcaagagcaatggataaggcagaggtgatccttcgacacatggttcgtaatggtgtccaaccacatgataggatatataataccctgatccatggatttttaacttcggatcagctgaaagaagcctttaggttgttgaaagtaatgagaagccaaggtagtatgccaaacgttgttacttgcacctcagtcatggactacctttgcaagcatggaagaatcaaagaagctgaggaaatattttattccatggccgtgaatggccgaaaccaaata

SEQ ID NO: 2691 - DNA, 1035 bp, Triticum aestivum; identical to SEQ ID NO: 2684

SEQ ID NO: 2692 - DNA, 1035 bp, Triticum aestivum; identical to SEQ ID NO: 2687

SEQ ID NO: 2693 - DNA, 1038 bp, Triticum aestivum; identical to SEQ ID NO: 2688

SEQ ID NO: 2694 - DNA, 975 bp, Triticum aestivum
atgatgaacaaaggtattcctcgtcctgacattgcgttcttcacttcaataataaatagtctatgcaaagaaggaagggttatggatgcacaaaatatctttgacttgcttgttgccatagatgagaggcctaatgtcattacatttaattcactaattgacggatattgcttagttggcgagatggataaagtattcagagtacttgatgccatgaaatcagttggtgctgagcctgatattgttacatacaatacacttgttaatggctattgtagaaatggaaggattgacgatgacttggctttgttcagggaaatgccatgtaagggaataaaacctgacactgttgcatattgcatcatactagatgggttgtttcatgccgggagaattgtcgttgcaaggaaaatgttccatgagatgatcgaaagtggaacaacagtgggcattcccatatacaatataacacttaaaggcctttctagaaataactgtgcacacgaagcgatagccatgttccagaaattaggtgcaatgaatgtgaagtttgatattgtcacactcaataccatgattaatgcattgtacaaggttggaaaaaaagaagaagctaaggatttgtttgctgcaatatcagccagcgggttggtgcctaatgcttccacttacagcataatgataataaattatctgaaggaaggatcagtggaagatgctaacaatattttttcatcaatggagaagagtggcatagctcccagttctcgtcttataaattatatcatcagaatatatttggaaaaaggtgagatcgccaaggctggagattatttgtccaaggttgatgggaagaacatcttacttgaagcttcaactacgtcgctgatgttgtctctcttttcaagaaacgggaaatatcaggagaatatcaaattgcttcctgcaaagtatcagtttttttatggatttggt

SEQ ID NO: 2695 - DNA, 975 bp, Triticum aestivum; identical to SEQ ID NO: 2694

SEQ ID NO: 2696 - DNA, 975 bp, Triticum aestivum
atgatgaacaaaggtattcctcgtcctgacattgcgttcttcacttcaataataaatagtctatgcaaagaaggaagggttatggatgcacaaaatatctttgacttgcttgttgccatagatgagaggcctaatgtcattacatttaattcactaattgacggatattgcttagtcggcgagatggataaagtattcagagtacttgatgccatgaaatcagttggtgctgagcctgatattgttacatacaatacacttgttaatggctattgtagaaatggaaggattgacgatgacttggctttgttcagggaaatgccatgtaagggaataaaacctgacactgttgcatattgcatcatactagatgggttgtttcatgccgggagaattgtcgttgcaaggaaaatgttccatgagatgatcgaaagtggaacaacagtgggcattcccatatacaatataacacttaaaggcctttctagaaataactgtgcacatgaagcgatagccatgttccagaaattaggtgcaatgaatgtgaagtttgatattgtcacactcaataccatgattaatgcattgtacaaggttggaagaaaagaagaagctaaggatttgtttgctgcaatatcagccagcgggttggtgcctaatgcttccacttacagcataatgataataaattatctgaaggaaggatcagtggaagatgctaacaatattttttcatcaatggagaagagtggcatagctcccagttctcgtcttataaattatatcatcagaatatatttggaaaaaggtgagatcgccaaggctggagattatttgtccaaggttgatgggaagaacatcttacttgaagcttcaactacgtcgctgatgttgtctctcttttcaagaaacgggaaatatcaggagaatatcaaattgcttcctgcaaagtatcagtttttttatggatttggt

SEQ ID NO: 2697 - DNA, 975 bp, Triticum aestivum
atgatgaacaaaggtattcctcgtcctgacattgcgttcttcacttcaataataaatagtctatgcaaagaaggaagggttatggatgcacaaaatatctttgacttgcttgttgccatagatgagaggcctaatgtcattacatttaattcactaattgacggatattgcttagttggcgagatggataaagtattcagagtacttgatgccatgaaatcagttggtgctgagcctgatattgttacatacaatacacttgttaatggctattgtagaaatggaaggattgacgatgacttggctttgttcagggaaatgccatgtaagggaataaaacctgacactgttgcatattgcatcatactagatgggttgtttcatgccgggagaattgtcgttgcaaggaaaatgttccatgagatgatcgaaagtggaacaacagtgggcattcccatatacaatataacacttaaaggcctttctagaaataactgtgcacacgaagcgatagccatgttccagaaattaggtgcaatgaatgtgaaatttgatattgtcacactcaataccatgattaatgcattgtacaaggttggaaaaaaagaagaagctaaggatttgtttgctgcaatatcagccagcgggttggtgcctaatgcttccacttacagcataatgataataaattatctgaaggaaggatcagtggaagatgctaacaatattttttcatcaatggagaagagtggcatagctcccagttctcgtcttataaattatatcatcagaatatatttggaaagaggtgagatcgccaaggctggagattatttgtccaaggttgatgggaagaacatcttacttgaagcttcaactacgtcgctgatgttgtctctcttttcaagaaacgggaaatatcaggagaatatcaaattgcttcctgcaaagtatcagtttttttatggatttggt

SEQ ID NO: 2698 - DNA, 975 bp, Triticum aestivum; identical to SEQ ID NO: 2694

SEQ ID NO: 2699 - DNA, 975 bp, Triticum aestivum; identical to SEQ ID NO: 2694

SEQ ID NO: 2700 - DNA, 975 bp, Triticum aestivum; identical to SEQ ID NO: 2694

SEQ ID NO: 2701 - DNA, 852 bp, Triticum aestivum
atgcactcaaatgaggcattggatctgctgctccaccggatgcccgaactggactgtgcgcctgatgtcttctcgttcaacatagtaatcaacggctgctttagagaaggtgaagtagacaaagcatgcaatctcttccatgagatgccccaactgggagttcaacctgatgtggtgacctacaactcaattatcatcgcactaagcagggccggrgcaatgggtaaggcagaagtggtccttcggcaaatggttgataaaggcattggacccgatgtcatgacatataacagtctgatccatggatattctactttgggtcagtggaaggcagcagttagggtattcaaagagatggtaagtgttggtgttctaccaaatgctgtcacgttgaactcatttatggattcactttgcaagcatagaaggacaaaggaagctagagatatttttgactccatggctgcaaagggccacaaacctaatattgcctcctactctactatgcttaatgggtatgcgaaacaaggatgcttcgatgatatgactggtctcttcaattcgatgctacagaatggtgttgtaccaaaccaccatattttcaacatactgatcaatgcatatgctaaacgtggactgatggatgaggctatgcacatgttcgaagtaatgaggcaacaaggagtaaacccagatgtatttagctatcaaattgtaatggattcactttgtaaatgggtaggatggatgctgctctggacaaatttaatcagatggtcaatcaaggagtttcacctaacaaagctgtttaccaatgcctggttctgggttcttgttctcatggtcattttg

SEQ ID NO: 2702 - DNA, 984 bp, Triticum aestivum
atgatgaacaaaggtatacctcgtcctgatattatgttcttccattcaatcatgcagaacctatgcacagaaggaagggtagtagaagcacgggatatccttggcttgatagcacacataggtatgaggcctaatgtttgcacatttaatatactgattggtggatactgcctagtccgcaagatggaggatgcctcaaaaatatttcatgatatgatgccatatggtttagaaccttctaatattacgtatggtatacttattaatggctattgcaaaaacttaaggattgacgatgggctgattctgttcaaagaaatgttgcgcaagggacttaaacctacaactttaaattataacattatactggatggcttatttctggctggacgaactgctgctgcaaaagagaagtttgatgagatggttgaatctggagcagatgtgtgcattgatacatactgtatagttcttggtggactttgtagaaataattgctacagcgaagcaatcatgctgttccagaaattaagcgcaatgaatgtgaaatttgatattacagttgtcaatatcattattggtgcattctacagggtccagagaaaccaagaggctaaggatttgtttgttgctataccagccaatggcttggttcctaattctgttacctacaccataatgatgagaaatcttataaaagaaggttcagtagaagaagctgacaatctttttttatcgatggagaatagcggctgtactgccaactctaatatgttaaatcttatcgtcagaatgttactggaaaaaggagagatagtcaaggctgggaattatatgtctaaagttgatgcaaagagctactcacttgaagctaaaactgtttcgctgctgatctctctcttttcagggaaagggaaatatagagaacacataggattgctccctacaaagtatcagtttcgtgaagaagcagccacggttgtg

SEQ ID NO: 2703 - DNA, 840 bp, Triticum aestivum
atgccagccgcccgcctgtcctccttcaaggctccttcacgagagcgccgacctcccctcgccgccttggctgccgccacggagcgcgtccgcgccggaacgctaagtcggcaggacgcgcaccacctgttcgacgaattgctgagccaagccgcgacagtcccagtacgcaagctgaacaactttcttgccgccctcgcccgtgcaccgccctcagctgcctgcagcgatggtccgggccttgccattgccctcttcaaccgcatgtcccgaggcgctggtgcacgggtggtgtcgcccacgctctgtacctattccatcctcatggactgctgctgccgtgcacgccgcccggacttggtggtggccttcttcggccgcctcctcaggttggggctgcgcttggaggtcatctccttcagcaatctcctcaaggggctctgccaggccaagcgtacaaatgaggcggtggacttgctgctccaccggacacctgaactggactgtgtgcctgatgtcgtctcgtacaacatagtaatcaacggctgtttaaaagaaggtgaagtagacaaagcgtgcaatctcttccatgagatgccccaactgggagttcaacctgatgtggtgacctacaactcaattattgacgcactaagcaaatccagagcaatggacaaggcagaagtagtccttcggcaaatggttgatcaaggcattggacccgatgtcatgacatatactagtctgatccatggatattccacttcaggtcagtggaaggaggcagttaggttattcaagaaaatgacaagtcttggtgctctaccataccgtcatgtg

SEQ ID NO: 2704 - DNA, 990 bp, Triticum aestivum
atgcccgacgacctgcctaatgccatctcctactcagtaattctcaagagtttctgcgacagtgggaggagccagcttgcgcttgacctgctccaaatgatggccaaaaaaggagctgaccactcccccgacgtggttgcatacaacatggtaatcgatggcttctttaaggagggcgaagtaagcaaagcatgcgatctgttccatgaaatgatacaacagggggttgtgcctactgtggtgacgtataactctgttatcgatgcgctatgcaaagcaagagcaatggacaaggcggaggtggttcttcgatcaatggttcataacggtgtacacccgaatactgtgacatataatagcttgatccaaggatattcaactttgggacagttgaaagaagtcgctaggttgttgaaagtgatgagaagccaaggtgttatgccaagcgttgttacctacaactcactcatggactacctttgcaagcatggaagaatcaaagaagctgaggaaatattttattccatggccgtgaatggccgaagaccagatatagtctcatactctattatgctccatgggtacgctatagaaggatcccttgttgaaatgattgatctctgtgagctgatggcaagagatggagttgtacccgacctccgttgtttcaacatactgattaatgcatatgctaagtatggtaggatggatgtggccatgcttttctttgaagacatgttgaagcagggtgtgaagcctaatgaattcacttatttaactgtgatatctgcattttgcaagatgggcaggatggatgatgcgatggaaaaattcagtgagatgattgatatcggagtaccacttgacacagaagtttacatgtgcatggttgagggttattttaatcatggtgattccatgaaagccgaggaatttattaccagaatgaagaacaaggatattaatcataagccgtgggaaggtaatcga

SEQ ID NO: 2705 - DNA, 990 bp, Triticum aestivum; identical to SEQ ID NO: 2704

SEQ ID NO: 2706 - DNA, 990 bp, Triticum aestivum; identical to SEQ ID NO: 2704

SEQ ID NO: 2707 - DNA, 990 bp, Triticum aestivum; identical to SEQ ID NO: 2704

SEQ ID NO: 2708 - DNA, 750 bp, Triticum aestivum
atgccagccgcccgcctgtcctccatctccacctcctccttcagggctccttcacgagcccccctcgccgccttggctgccgccacggagcgtgtccgcgcgggaacgctgagccaggatgacgcgcaccacctgttcgaccaattgcttggccaagccgccgccgtcccggaacgcgggctcaacaactttcttgccgcactcgcccgtgctccaccctcagctgcctgccgcgatggccccggccttgccatcgccctcttcaaccgcatgtcccgaggcgctggtgcacgggtggcgtcgcccacgctctgtacctattccatcctcatggactgctgctgccgcgcaggccgcccggacttggtgcttgccttcttcggccgcctcctcaggttggggctgcgcttggatatcatctcctccagcaatctcctcaaggggctctgccaggccaagcgttcaaatgaggctttggacatgctgctccaccggatgcccgaactggactgtgtgcctgatgtcttctcgtacagcatagtaatcaacggctgttttaaacaaggtgaagtagacaaagcgtgcaatctcttccatcagatgccccaactgggagttcaacctaatgtggtgatctacaactcagttatcgacgcactaagcaaatccggagcaatggacaaggcagaagtggtccttggcaaatggttgatcaaggaattgaacccaatatcaagacatataactgtc

SEQ ID NO: 2709 - DNA, 750 bp, Triticum aestivum; identical to SEQ ID NO: 2708

SEQ ID NO: 2710 - DNA, 972 bp, Triticum aestivum
atgctacagaggggaatttcgccgaatgttgtgacctgcaattcaatcatctctggcatgtgcaaagttcatgcgatggacaaggcagaggaggttcttcaacagatgactgatagaggtattctgcctgatgttgccacatataccagtctcatacatggatattattcattaggacagtgcaaagaggtggatcggattttcaaggagatgactagaaatggtgtccaaccaaatgttgtaacttatagtatacagatggattatctttgcaagagcggaagatgcgcggaagctaggaagatctttgattctatggtcagtttgggccaaaaaccgtctgttactacctacagtattctgcttcatggttatgttatggaaaaatcatttcatgatatgcattgtctccttgattttatggtagaaaatggtatctcaccagatcatcatgtctacaacatactcatatctgcatatgctaaagaggaaatggcaagtgaggtaatgcatatatttacaaaaatgcggcagcaaggattgaaccctagtgttgcggactatggagcggtaataaacttgctttccagtattggcagaatggatgatgctatgtcccaattcaatcaaatgatagccgaaggattagctcctgatatcatagttttcaacccccttattagtggtttttgtacttgtggcaaatgggagaaggttcatgaactattttctgaaatgttgaatcgcggcacctatcatgataccgtgttcttcaccacaattatggaccgcctttgcaaaaatggaagggttatggaatcccaagatatgtttgacctgatggtacacgtgggtgttaagcctaatgttcatacttatgccacattgatgcatgggtactttttcgttaggaagatggatgaagtgaggaagttagttggcaatatgctctcaattggctcgaaaccggat

SEQ ID NO: 2711 - DNA, 846 bp, Triticum aestivum
atggccctgccctcgccacgcatggcccaagcaggtcgtcgccaggtgccagcaccctccatttacacctacaacatactaattgactgctgccaccgagcatgccggccggacctagggcctgccttcttcggtcgcctcctcaacacaggcatcacaatgagcgtcattacctacatcagcctattcaagtgcctctgtgacatgaagcgcacagaggaggctctgaacgtgctgctccatagaatgcccgacgacctgcctaatgtcatctcctactcagtgattctcaagagtttctgcgatagtgggaggagccagcttgcgcttgacctgctccaaatgatggccaaaaaaggtgctgaccactcccccgacgcgatgtcatacaacatcgtaatcgatggcttttttaaagagggtgaagtaagcaaagcatgcgatttgttccatgaaatgatgcagcagggggttgtgcccgatatggcaacgtacaactccgttatcgatgcgctatgcaaagcaagagcaatggacaaggcagaggtggttcttcgatcaatggttcataatggtgtccaaccagatgttgtgacatataatagcttgatccaaggatattcaactttgggacagttgaaagaagtcgctaggttgttgaaagtgatgagaagccaaggtgttatgccaagtgttgttacctacaactcactcatggactacctttgcaagcatggaagaatcaaagaagctgaggaaatacttgattccatggccgtgaatggccgaaaaccagatctcatactctattatgctccatgggtacgctatagaaggatcccttgt

SEQ ID NO: 2712 - DNA, 846 bp, Triticum aestivum; identical to SEQ ID NO: 2711

SEQ ID NO: 2713 - DNA, 846 bp, Triticum aestivum; identical to SEQ ID NO: 2711

SEQ ID NO: 2714 - DNA, 846 bp, Triticum aestivum; identical to SEQ ID NO: 2711

SEQ ID NO: 2715 - DNA, 846 bp, Triticum aestivum; identical to SEQ ID NO: 2711

SEQ ID NO: 2716 - DNA, 846 bp, Triticum aestivum; identical to SEQ ID NO: 2711

SEQ ID NO: 2717 - DNA, 762 bp, Triticum aestivum
atgccccgtctccgcctccgtcgcttctccaccgcgccgatgttccacctcctccgccgcagctcctcctccaccaccacctcgccgccctcgcgttcctggtctccccacgccgcctttgccgccgccacggagcgcatcagcgccgggacgctcagccgggaagacgcgcaccgcctgttcgacgaattgctacggcaggccaccccggtccccagccgctccctaaacggcttcctcgccgccctcgcgcgtgctacgtcctctgccgcctgcatcagagatggtcgcgccctcgccatcgccctcttcaaccgcgtgtgtcgagagcaatccggcccgcgggtggtgcctctcacagtccacacgtacaacatcctcatggactgctgctgccgcgcgtctcgcccggacctaggtcttgccttcttcgctcgcctcctcaggacaggcctgaagacaaacgagatcaccgccaacaccttcctcaagtgcctctgctacgcaaaacggacggatgaggctctgaacgtgctgcttcataggatgtccgagctcggctgtgtgcctgatgccatctcatacaacattgttctgaagagcttatgtgaagatagcatgagtcagcgggcgctcgacctcctccagatgatggcgaaagaaggaggtggctgctcccccaacgtggtggcgtataacacggtcatccatggcttttttaaggaaggtgaaacaggcaaggatgcaatctgttccatgaaa

SEQ ID NO: 2718 - DNA, 762 bp, Triticum aestivum; identical to SEQ ID NO: 2717

SEQ ID NO: 2719 - DNA, 762 bp, Triticum aestivum; identical to SEQ ID NO: 2717

SEQ ID NO: 2720 - DNA, 975 bp, Triticum aestivum
atgcggcagcaaggattgaaccctaatgttgtgaactatggagcggtaataaacttgctttctagtattggccgaatggatgatgctatgtcccaattcaatcaaatgataactgaagggttagctcctgatatcatagttttcaactcccttattagtggtttctgttcttgtggcaaatgggagaaggttcatgaactattttctgagatgttggatcgtggcatctgtcccgacagagtgttcttcaacactgttatggatcacctttgcaaaaatggaagggttatggaagcccaagatgtgttcgacctgatggtacacatgggtgtgaagccttttgtccgtgattacaacacactgattcatggatactgtttagttggtaagatggatgaagggaggaagttacttgataatatgttctcaattggcttgaaaccgggtgatttcacctatagcatactgattgatggttactctaagaagggaaggatagatgatgcattgattattgtcagggtaatgttggacgggaaggttaagccttctattatcacttttaatattatgattggtgcgttgcttaaaggtggcagaaaggaagaagccaaagatttgtttaatggtatctgggccaaaggattagtgcccgatgttgttacatatagcttaatgatacaaaaacttatagaagaaggttctctacaagagtctgatgatctattcctttctatggagaagaatggatgtgctgccgactcccgcatgctaaatgctatagttagaagcttacttcagaaaggggacgtgcccagggctgggacttatctgtctaaaattgatgagaggagcttcacccttgaaggttccacagctagcttgttgactgcacttgcttcagggaggaaaggccaggaatataaggggttactccccgaaaaataccactattttctggaacagggcactgat

SEQ ID NO: 2721 - DNA, 957 bp, Triticum aestivum
atgcctcgcttctcctccaccacgtcaatgtcgccactgcgcctccgcctccgcctccacgcccgccactcctccgcctctcaaccctcacgcagccagggctgggatccccacgccgccttcgccgccgcgacgcagcgtgcgcgctctggcagcctcacaccggcggacgcacaccacctgttcgacgaattgctgcggcaggccaatcctgtccaggagcgccccctcaacaaccttctcgccgccatcgtccgcgctccggcgtccaacgcctgcagaaacggccctgcactcgcggtcgccctcttcagtcgcatatcccaaggcgcccgccgacgggtggcgcagccaaatgtcttcacctatggcgtcctcatggactgttgctgtcgtgcgcgccgcctggatctagcaatcgccttcttcggccgtctcctcaagacgggcctggaggcagacctagtctttttcagcaccctcctcaagggactctgccacgcaaagcgctcagatgaagctctggacgtgctgctgcacaggatgcctgagctgggctgcacccccgacgtggtggtgtataacaccgtcatccatggattctttagggaaggccaagtaggcaaggcgtgcgatatgttccatggaatggcgcagcagggcgttgcgcctaatgtggtgacatataactcggttattgatgcgctgtgcaaggccagagcaatggacaaggccgagtatttccttcgtcaaatggttgataatggtgtcgtacctgataatgtgacttataatagcctcatccatggatactcctcttcaggccatcaaaaggagacgcttagggtgctgaaagaaatgacaagtcagggtattataccagatgttgttacttgcaactcgctcatggcctacctttgcaagaacggaagaagcaaagaagctgcagaatttttt

SEQ ID NO: 2722 - DNA, 963 bp, Triticum aestivum
atgccccgtcgtctcccactcgccttgctcccacttcacaccaaggccatgcctcgcctctcctccaccacgcccatgtcgccactccgcctccgcctccgcgcccgccactcctcctccacctcccattcctcacgcagctgggagccccacaccgccttcgccgccgccacggagcgtgcgcgctctggcaacctcaccccggaggacgcacaccacctgttcgatgaattgctgcggcaggccaatcctgtccaggagcgcccgctcaacaaccttcttgccgccctcgcccgcgctccggcgtccgcggcgtgcagtgatggccttgcactcgcagtcaacctcttcagccgcatatcccaaggcgcccgctgtgtggcgcacccaacggcctgcacctacggcatcctcatggactgttgctgccgcgcacaccgcctcgatctggcgtttgctttcttcggccgtctcctcaggacgggacttaaggcaggcgtcattcaagtttgcactcttctcaagggcctctgccacgcaaagcgcacagatgaggctctcaacgtgctgcttcacaggatgactgagctgggctgcacccctgacgtggtggcgtataacacggtcatccatggcttcttcaaggaaggccaagtaggcaaggcgtgcagcctgttccatgaaatggcgcagcagggcgttgcgcctaatttgatgacatatacctcggttattgatgcgctgtgcaaggccaaagcaatggacaaggcagagtatttccttcgtcagatggttgataatggtgtcgtacctgataatgtcacatataatagcctcatccatggatattcctcttcaggccattggaaggaggcagttagggtatccaaagagatgacaagtcggagggttacagcagatgtgcatacttacaacatgtttatgacctttctttgcaaacat

SEQ ID NO: 2723 - DNA, 963 bp, Triticum aestivum; identical to SEQ ID NO: 2722

SEQ ID NO: 2724 - DNA, 963 bp, Triticum aestivum; identical to SEQ ID NO: 2722

SEQ ID NO: 2725 - DNA, 963 bp, Triticum aestivum; identical to SEQ ID NO: 2722

SEQ ID NO: 2726 - DNA, 963 bp, Triticum aestivum; identical to SEQ ID NO: 2722

SEQ ID NO: 2727 - DNA, 963 bp, Triticum aestivum; identical to SEQ ID NO: 2722

SEQ ID NO: 2728 - DNA, 636 bp, Triticum aestivum
atggacagctgctgccgtgcacgtcgcccggacctaggccttgccttcttcggccgcttcctcaggacgggcctcaaggcagacctgatcgtcgccagcaccctcctcaagtgcctctgccatgtaagacggacaaatgaggctgtcaacatgctgcttcataggatgtccgagttcggttgtgtgcctgatgccatctcatactccatagtacttaagagcttatgtgacaatagcaggagccagcaagcgctcgacctgctccagatggtgaggaaagaacgaggtgccagctccctcaatgtggtggcatatagcataatcatacacggcttctttaaggaaggggaagtaagcaaggcatgcgatctgttccatgagatgatgcagcaagggattgtgcctgatgtggtgaaatataggtcggttattgatgccttgtgcaaggtcagggcaatggacaaggcaaagctggtccttcagcagatggttaataatggcgttcgaccaaatatgtatacttggaactcatttatgtactccctatgcaagcatggaagaagcaaagaagctgcagaattttttgactccatggtagaaacagctagggttctaccaggcctagggcgtagttta

SEQ ID NO: 2729 - DNA, 933 bp, Triticum aestivum
atgaagttcagtgcagttccaagtttggttgagtgtctgacctccgccggtcatccagtctccagtggtttgtcgtcgccgacacgctcccacattcgccactgcaggaaggagcaagacctcccacgtctgacccggtcgtcctccagctccggctcctcacgggtcaaccagctgctaaacaaactcaaggattatcttggctctgggacgctcaggccggagctcgcgcaccaactgttcgtcgaattgtttcgtcaaaccgttccggtatcagcagacgcactcaatgtcttattttctgccctcgcgtgtgggctgccctctgccgcctgcaatgatggtcctgccctcgcaatcgccctcttcaaacacatggcacgagcaagatgccgccaggtgatggcacccaccaatcacacttacaacacactaattgagtgctgccacatggcacgccgccctgacatagggctcgtcttctttggcctcctcctcaagataggcatcacggcagatgtcttcaccttcaacagcttattgaagtgcctctgtgacatgaagcaaacagatgaggctctaggcgtgctgctccacaggatgcccggcgacatgcctgatgtcatctcctactcagtaattatcaagagcttctgtgacaacgggaggagccaccgtgcacttgacctgctccggatgatgaccaaaaagggatatgaccactcccccaatgtggtttcatacacaataatcattgatggattaattaaggagggtgaactaagcaaagcatgtgctctattccatgaaatgatgcagcagggggttgtgcctgatgtggtgacgtatagctccattatcgatgggttgtgcaaagcaagagcattggacgaggcagaggtggtccttcgacaaatgattgatagcggtgtt

SEQ ID NO: 2730 - DNA, 933 bp, Triticum aestivum; identical to SEQ ID NO: 2729

SEQ ID NO: 2731 - DNA, 933 bp, Triticum aestivum; identical to SEQ ID NO: 2729

SEQ ID NO: 2732 - DNA, 933 bp, Triticum aestivum; identical to SEQ ID NO: 2729

SEQ ID NO: 2733 - DNA, 933 bp, Triticum aestivum; identical to SEQ ID NO: 2729

SEQ ID NO: 2734 - DNA, 933 bp, Triticum aestivum; identical to SEQ ID NO: 2729

SEQ ID NO: 2735 - DNA, 804 bp, Triticum aestivum
atgcgcccatgccggacgcctctcctcgactccacctcgccgctgtccgtgctcctactcgaccacctccaccgcaatcgcccctcccctcccccctcagcctcgccgccgtcagccatctggtctcccatcgccgcattcgccgctgccacgaagcgcgcccgagccgggacgctcagccctgaggacgcacaccacctgttcgacgaattgctacgccagtccatcccggtccccaaccgcttcctgaacggcttccttgccgccctcgcccgtgccccagtctccgaagcctgcggagatggccccgccctcaccgtcgccctcttcaaccgcctctgccgagaagaagccggcccttgtgtagagccgcccacttactatacctacagcattctaatggacagctgctgccgcgtgggtcgccccgaccttgggcttgctttcttcggccgcctactcaagtcaggcctcaaggcagaccagatcaccgccagcagcctcctcatgtgcctctgcgatgcaggacggacaaacgaggctgtggacgtgctgcttcataggatctccgagctcggctgtgagcctaatgtcatcccatacaacatagttcttaagagcttatgtgacagtagcaggagccagcgagctcttgacctgctccagatgatggcacaaagagcttgctgctcccctaatgtggtgtcatataacaccgtcattcagggcttatttaaggaaggccaagtaagcatggcgcgcacattcttcttctatgaaatgatggggttatgcctaatgtgg

SEQ ID NO: 2736 - DNA, 804 bp, Triticum aestivum; identical to SEQ ID NO: 2735

SEQ ID NO: 2737 - DNA, 804 bp, Triticum aestivum; identical to SEQ ID NO: 2735

SEQ ID NO: 2738 - DNA, 804 bp, Triticum aestivum; identical to SEQ ID NO: 2735

SEQ ID NO: 2739 - DNA, 804 bp, Triticum aestivum; identical to SEQ ID NO: 2735

SEQ ID NO: 2740 - DNA, 804 bp, Triticum aestivum; identical to SEQ ID NO: 2735

SEQ ID NO: 2741 - DNA, 963 bp, Triticum aestivum
atggattatctttgcaagagtagaagatgtgcggaagctaggacgatttttgattctatggccggaaaggaccaaaaaccgaacgttactagctacagtattctgcttcatgcgtatgctatggaacagtcatttcatgatatgcattgtctcattgaattgatggtagaaaatggtgttgcaccaaatcattctgtgtacaacatactgatagacgcatatgctaaggggaaaatggttgatgatgtaatgcacatatttacaaaaatgcggcagcaaggattgaacccaaatgctgtgaactatggaacagtaataaacttactctgcagtattggccgaatggatgatgctatgttgcaattcaatcaaatgataactgaagaattagttcctgatatcatagttttcaacactcttataagtggttttttttcttgtggaaaatgggagaaggttcatgaactacttgctgaaatgttgaatcgtggcatctatcccgacaacgtgttcttcaacacaattatggatcacctttgcaaaaatggaagggttatggaatcccaagatctcgctgacctgatgatacacatgggtttgaagcctgacgtgcatacttataacacactgatgggtggatactttttcattggtaagatggatgaagtgaggaagttacttgaccatatggtctcaattggcatggaaccggatgttgtcacctataacacactgattgatggttactttaagaatggaatgatagatgatgcgttagctgttttcagtgaaatgttggacaagaaagttaagccttgcgttatcacttataacacagtgctgcatgggttatttcatactggaaggactgttgctgcaaatgaactctatctcaggatgattgacagcggaatatgtgtggacattgtgacctacaacaactccgcctatgttgtctcaaca

SEQ ID NO: 2742 - DNA, 963 bp, Triticum aestivum; identical to SEQ ID NO: 2741

SEQ ID NO: 2743 - DNA, 963 bp, Triticum aestivum; identical to SEQ ID NO: 2741

SEQ ID NO: 2744 - DNA, 963 bp, Triticum aestivum; identical to SEQ ID NO: 2741

SEQ ID NO: 2745 - DNA, 963 bp, Triticum aestivum; identical to SEQ ID NO: 2741

SEQ ID NO: 2746 - DNA, 963 bp, Triticum aestivum; identical to SEQ ID NO: 2741

SEQ ID NO: 2747 - DNA, 909 bp, Triticum aestivum
atgctccgccgcatccgcatccgcatccgcctccgtcgccgcccctacccctcctgcacctacccggagcccgtcctctgccactcctccagctttatctctgcggctcccctcctccgcctccaccagtaccgcaccaccaccacgccgatgtcccgcatccacctccgccgtcgcctcttctcctccaccacgcggccctcgcactcctggtctccacatgccgcctttgccgcagcaacaaagcgcgtacgcaccggggcgctcagccaagacgatgcacaccacctgttcgacgaattgctgcggcaggccaccccggtccccgggcgctccctcaacggcttccttgccgccctcgcccgtgcgcccgcctccggagcctgcagagatgggcccgccctcgccctcgctctcttcaaccgcgtctgccgggatgaatccggcgcgcgggtggcaccgcccacaatcttcacctacggcatcctcatgaactgctgctgccgcgcgcatcgcccggacctagggctcgccttcttggctcgcctcctcaggacgggcctgaaggctgaccagatcaccgccaccaccttcctcaagtgcctctgctacgcaaaacggacggatgaggctgtgaacgtgctgcttcataggatgcccgagctcggctgtgtgcctgacgccttcgcatactccactgttctgaagagcttatgcgacaatagcatgagtcagcgggggctcgacctgctccatatgatggcgaaagaaggaggtggctgctcccccaacgtggtggcgtgtagcaccgtcatccatggcttctttaaggaaggtgaaacaggcaaggcatgcaatctgttccatgaaatgatgcagcaaggtgttgagcccaatgtgtggacatac

SEQ ID NO: 2748 - DNA, 909 bp, Triticum aestivum; identical to SEQ ID NO: 2747

SEQ ID NO: 2749 - DNA, 909 bp, Triticum aestivum; identical to SEQ ID NO: 2747

SEQ ID NO: 2750 - DNA, 861 bp, Triticum aestivum
atgttggatcgcggcatctgtccagacacagtgttcttcaacactgttatggatcacctttgcaaaaatggaagggttatggaagcccaagatgtgttcgacctgatggtacacatgggtgtgaagccttttgtctatgattacaacacactgatacatggatactgtttagtttgtaagatggatgaagagaggaagttacttgacaatatgttctcaattggcttgaaacctgatgatttcacctatagcatactgattgatgattactctaagaagggaaggatagatgacgcattgattattgtcagggaaatgttggacgggaaggttaagccttctattatcacttttaatattatgattggtgtgttgcttaaaggtggcataaaggaagaagccaaagatttgtttgatggtgtctgggccaaaggattagtgcctgacgttgttacatatagattaatgatacaaaagcttatagaagaaggttctctacaagagtctgatgatctattcctttctatggagaagaatggatgtgttgccgactcccatatgctaaatgctacagttagaagcttacttcagaaaggggaggtgcccatggctgggacttatctgtctaaaattgatgagaggaggttcacctttgaagctcccactgctagcttattgactgcacttgcgtcagggggaaaggccaggaatataaggagttactccctgaaaaataccactcttttctggaacagggcactggttgaaaccatttctagagattttgcctacatattctggactgctattcgaggcctgaacttttctttgtgggttacatctcccaaccttttattttcg

SEQ ID NO: 2751 - DNA, 861 bp, Triticum aestivum; identical to SEQ ID NO: 2750

SEQ ID NO: 2752 - DNA, 861 bp, Triticum aestivum; identical to SEQ ID NO: 2750

SEQ ID NO: 2753 - DNA, 879 bp, Triticum aestivum
atgtttgacttcattgtaggtattggtcagcggcctgatgtgattatgtacaattcactgatggatggatattgccttgttggcaaagtggaggaagcactgagagtacttgatgctatgaagtctgctggcctccaacctgatgcttttacatacggtatacttcttaatggctactgtaaaattggaaggatcgccgctggattgagtcttttcatggaaatgtcactcagcagggttaagcccacgactattatgtacaacattatacttgatgggctgtttcgctccgggagaacagtttctgcaaaggaaaaattccgtacgatgagcgaaagtggcataccagtgggcattgacacatacaacatagttcttaatggactttgcaaaaacaattgcactgatgaagcaatagagctgttcaagaaattacgtgcaacgaacgtgaagattgatgtcataacattcagtaccatgatttctgcaatgtttaaaactaggagaattgaagaggccaaggatttgtttgctactatatcagccattgggttggtgccttctgttgtgacttacagtttaatgatgacgaatttcataaaagaagggttgctggcagatgctgatgatatgtttttagcaatggagaaggctggctgtgctcctgactccaggctgctaaatcaagtggtcagggtatttctgaagaatggtgaagttgtaaaggctgtgacttatctcgctaaacttgatgctaaacagctgtcagttgaagcttcaacgatttcgttaatagtatctctcttctcaaggaaagggaaattaagggagcacgtaaaattgcttccggtaaagtaccagcctcctgagatgttgggc

SEQ ID NO: 2754 - DNA, 879 bp, Triticum aestivum; identical to SEQ ID NO: 2753

SEQ ID NO: 2755 - DNA, 879 bp, Triticum aestivum; identical to SEQ ID NO: 2753

SEQ ID NO: 2756 - DNA, 879 bp, Triticum aestivum; identical to SEQ ID NO: 2753

SEQ ID NO: 2757 - DNA, 879 bp, Triticum aestivum; identical to SEQ ID NO: 2753

SEQ ID NO: 2758 - DNA, 879 bp, Triticum aestivum; identical to SEQ ID NO: 2753

SEQ ID NO: 2759 - DNA, 852 bp, Triticum aestivum
atgcatggtgatctggtgaaagtgaaggagttgatttttgaaatgacggacaaaggtattcctcaccctaacattgtcttcttcagttcaataatgcatagtctgtgcaacgaaggaagggttatggatgcacaccatatctttgacttggttatagacattggtgagagacctgatctcattacatttaatacgctaattgacagatattgcttagtcagcaagatggaggaagcactccgactacttgattccatggtatcagctggcattaagccaaatgtgattacatataatacacttattaatggctataggagtggaaggctcgatgatggcgttattctatttagagaaatgttgcataccagagttaaacctaacactgttacatataacatcatactggatgggttatttcgtgctggaagaactgtttctgcgaagaagatgttccatgagatgatcgaaactggaacagcagtgagcatttccacatacagcatagttcttggaggactttgtaggaataactgcaccgatgaagcaatcgcttttttccaaaaattagttgcaatgaatgtgatgttcaatattgcgatactcaataccataattaaggcaatgtacacggttcagagaagagaagaagctaacgatttgtttgcttcattaccagcctatggactagtgcctaatgctgctacttacggagtaatgataagcaatcttctgaaagaaggatcgttggaagaagctgacaatatgttttcatcaatggagaagcgtggttgtgctccaagctctcgtcttgtaatgatatcatcagaaaattattggaaaagggggaga

SEQ ID NO: 2760 - DNA, 867 bp, Triticum aestivum
atgcctcgcctctcctccaccacgaccacgcccatgtcgcctctccgcctccgcctccgcctccgcgcccgccactccgcctcaacctcccattcctcacgcagctgggagccccacgccgccttcgccgccgccgcggagcgtgcgcgctctggcaacctcaccccggaggacgcacacgacctgttcgacgaattgctcaggcagggcaatcctgtccaggagcgccccttgaacaaactcctctccgccctcgcccgtgctccggcgtccgcggcctgcagaaacggccctgcactcgcggtcaacctcttcagccgcatatcccaaggcgcccgcctacgggtggcgcagcctacagcctgcacctacggcgtcctcatggactgctgctgccgcgcacaccgcctggatctgacgctggccttcttcggcggtctccttaggacgggcctggaggcagaccaagtcatcttctgcaccctcctcaagggactctgccacgcaaagtgcacagatgaggctctcaacgtgctgcttcacaggatgcctgagctgggctgcacccccaatgtggtggcgtataacaccgtcatccatggcttctttagggaaggccaagtaggcaaggcgtgcaatctattccatgaaatgaggcagcagggcgttacacctgatgttgtgacatataactcggttattgatgtgttgtgcatgttggttgatctcggctctgaccgggtaaaaagtaacgttaaggggatgagccaggaaccaacgttcgtggcttttgaccccaacagaattgccctgatcgggggcacctctaaccgacagatggttttggtcccctattgccagcgcata

SEQ ID NO: 2761 - DNA, 867 bp, Triticum aestivum; identical to SEQ ID NO: 2760

SEQ ID NO: 2762 - DNA, 900 bp, Triticum aestivum
atgcctaatgtggtgacatatagcttgatggttggtgggttgtgcaaggtcggggcaagggacaaggcaaagctggtccttcggcatatggttggtaatagtgttcgaccagatatgtatacttggaactcattcatgggatctcttcgcaagcagggaagaagcaaggaagctacacaactttttgattacatggccgccaagggccacaaacctgatgttgtcatgtactctactctgcttcatgggtatgctactgaaggatgcttcactgatatgattaatcgctttaattcaatggaaggcaacggtattgtagctaacagccgtgtttttaacatactaatcgacgcatatgctaaacgtggaatgatgcatgaagctatgctcatatttactgaaatgcgggaacaaagagtgagtcctgatacattcacctatggaattataatagctgcactttgcagaatgggtaggctatctgatgctatggagaaattaaatgaaatggttgctacaggattacagccggacgaggctgtttactattccctaattcagggtttttgtacacatgatgatttggtcaaagctaaggagttggtttctgagatgatgaccaaaggtattcctcgtcctaacattgtgttcttcaactcggtaatagccaggctgtgcaaagaaggaagggttaaggatgcacacggtatctttgacttggctatgaacattggtgagaggcccaacgttattacatttaattcactgattcacggctatagcttggttggcaagatggcgaaagctttcggggtacttgatgacatggaatcagttggcattgagcccgatgttgttacttatactacacttcgtcatggctattctagaaatagaagg

SEQ ID NO: 2763 - DNA, 900 bp, Triticum aestivum; identical to SEQ ID NO: 2762

SEQ ID NO: 2764 - DNA, 900 bp, Triticum aestivum; identical to SEQ ID NO: 2762

SEQ ID NO: 2765 - DNA, 900 bp, Triticum aestivum; identical to SEQ ID NO: 2762

SEQ ID NO: 2766 - DNA, 900 bp, Triticum aestivum; identical to SEQ ID NO: 2762

SEQ ID NO: 2767 - DNA, 900 bp, Triticum aestivum; identical to SEQ ID NO: 2762

SEQ ID NO: 2768 - DNA, 891 bp, Triticum aestivum
atgatggttgaggatggaggtagctgccaacctagtgtggtgttctataacatcatagtttatgtcctgttgaaagagggtgcgatgggcaaggcttacaacctattttgtgaaatgctacagacggggatttcgccggatgttgtgacctataactcaatcatctatggcatgtgcaaggttcatgcgatggacatggctgaggaggttcttcaacagatgtttgatagaggtattcttccaaattatagaacatataatagtctaatacatggatattattctttaggacagtgcggagaggtggatcaggttttgagggaaatgtttggaaatggtgttcaaccaaatgtcgtaacttacagtgtacaaacggattatctttgcaagagtggaagatgcacagaagctaggaagatttttgattctatgaccggtttgggccaaaaaccaactgttactaactacaacattttgcttcatgggtatgctatggaacgatcatttcatgatatgcattgtctcattgatttgatggtagaaaatggtattgtaccacatcaccatatctaccacatactgatatttgcatgttctaaagaaaaaatggttgatgaagcaatgcatatatttaaaaaaatgcggcagcaaggattgaaccctaatgcagcgagctatggaacggtaataaacttgctttgcaacattggccgaatggatgatatgatgttacaattcaatcaaatgataacggaaggattagctcctgatatcatagttttcaacacccttttgattggtttttgttcttgtggcaaatgggagaaggtttatgaactattttctgaaatgttgaatcgtggcatctatccagtaatgtgttcttcaaga

SEQ ID NO: 2769 - DNA, 864 bp, Triticum aestivum
atgatggatgaagctatgctcatattttctggaatgtgcggacaaggagtgactccagagtctagaatggctaggctggctgatgctttgaataagttcagtcagatgatttcaactgatatacaaccgaacacagttgtttatcactccctaattcagggtttctgtgcatatggcgattcggtgaaagcaaaggagttggtttatgaaatgataaacaatggttttcctcgtcctaacattgtgttcttcagttcaataataaatagtctatgcaaagaaggaaaggttatagatgcacaagatatcttcaacttggttgtagaaataggtgagagtcctgatgtcactatatttacttcactaattgaaggattttgcctagtcggcaaaatggagaaagcatcccaagtgtttgattccatggtatcagttggcattgagcctaatattgttacatatggtacacttgttgatggctattgtagaagtggaaggatagatgatgggttgattctattcagagatttgcttcacaagggagttaaacctacaacaattacatattacatcatactggatgggttatttcttgctgggagaacagttgctgccaagaaaatgttccatgagatgatcggaagtggaacacccgtgagcctgcacacatatgatataattcttggaggtctttgtaggaataattgtgctgacgaagcgattaccctgttccagaaattagtagcgatgaatgtgaagttggatattacaatacacaataccatgatcaatgcaatgttcaaagttcagagaagagaaaaagctaacgatttttgctgcagtatcagccagtggattggtacc

SEQ ID NO: 2770 - DNA, 732 bp, Triticum aestivum
atgatggatgaagctatgctcatattttctggaatgtgcggacaaggagtgactccagagtctagaatggctaggctggctgatgcttcgaataagttcagtcagatgatttcaactgatatacaaccgaacacagttgtttatcactccctaattcagggtttctgtgcatatggcgattcggtgaaagcaaaggagttggtttatgaaatgataaacaatggttttcctcgtcctaacattgtgttcttcagttcaataataaatagtctatgcaaagaaggaaaggttatagatgcacaagatatcttcaacttggttgtagaaataggtgagagtactgatgtcactatatttacttcactaattaaaggatattgcctagtcggcaaaatggagaaagcatcccgagtgtttgattccatggtatcagttggcattgagcctaatattgttacatatggtacacttgttgatggctattgtagaagtggaaggatagatgatgggttgattctattcagagatttgcttcacaagggagttaaacctacaacaattacatattacatcatactggatgggttatttcatgctgggagaatagttgctgccaagaaaatgttccatgagatgatcggaagtggaacacccgtgagcctgcacacatatgatataattcttggaggtctttgtaggaataattgtgctgacgaagcgattaccctgttc

SEQ ID NO: 2771 - DNA, 864 bp, Triticum aestivum; identical to SEQ ID NO: 2769

SEQ ID NO: 2772 - DNA, 864 bp, Triticum aestivum; identical to SEQ ID NO: 2769

SEQ ID NO: 2773 - DNA, 732 bp, Triticum aestivum; identical to SEQ ID NO: 2770

SEQ ID NO: 2774 - DNA, 864 bp, Triticum aestivum; identical to SEQ ID NO: 2769

SEQ ID NO: 2775 - DNA, 876 bp, Triticum aestivum
atgtcgcgcctccatccccgctacttctccagctccgtctcctcactcgccgacgagctgctgagcgaattccagcatcatctgggctcagggacgctcagtccgcagctcgcacaccaactgttcgacggattgctgcgccaaccagtcccagtatcagcgcgtgcactcaatggcttatttgctgccctcgcgcgtacgccgccctccaccacctgcgcagatggccctgcccgcgccatcgatctcttcaaccgcatggcccgagcaggccgccgccgcagggtgatagcacccaccagtcacacctacagcatactaattgaatgctgctgccttgcacgccgtccggaccttgggccttccttcttcgctcacctcctcaagacaggcgtcacggcagacgtcgtcatcttcagtggcttattcaagtgcctttgtgacatgaagcgcacggaggaggctctggatgtgctgcttcatagggtgcctcacgacctgcctaatgtcatctcctactcagtaattgtcaagagcctctgcgacaatgggaggagccagcttgcgcttgacctgctccatataatggccaaaaaaggtgctgaccactcccctaacgtggtgtcatacaacatggtaatcgatggcttttttaaggagggtgaaacaagcaaagcatgcgatctgctccaggaaatgattcagcagggggttgtgcccgatgtggtgatgtatagctccattatcgatgcactgtgcaaagcaagagcaatggacaaggcagaggtggtccttcgacaaatggttcatgatggtgatgtgacagcggcccgatctttcgatgagagtggggataattatcgatttggtggattt

SEQ ID NO: 2776 - DNA, 702 bp, Triticum aestivum
atggataaggcagagctgatccttcgacatatggttcatagtggtgtccaaccacatgataggatatataataccctgatccatgggtttttaactttgggtcagcagaaagaagcctttaggttgttggaactgatgacaagccaaggtgttatgccaaatgttgtgacttgcaactcagtcatggactacctttgcaagcatggaagagtcaaagaagctgcagaaatattttattccatggttgtgaagggccaaaaacctaatgtcatctcatactctgttatgctccacgggtatgctaaagaaggatcccttgttgctatgattgatctctgtgagctgatggcaagagatggagttgttcccgaccgctcttttttcaacatactgattaaggcatatgctaaatatggaatgatcgatgtggctatgcttttctttgatgaaatgttgaagcagggggtgaaccctaatgatatcacatatttaactctgatatctgcattttgcaagatgggcagaatggatgatgctatgatcaaattcaatgagatgattgatatgggaataccacatgatacaactgtttacatgtgcatgattgagggctatttgaatcatggtgattccgtcaaagccaaggaattcattactaaaatgaagagcagggatgtttgtcatagcccacggaagggtaat

SEQ ID NO: 2777 - DNA, 840 bp, Triticum aestivum
atggtaatggatggcttttttaaggagggtgaagtaagcaaagcatgtgatctattccacgaaatgatacagcagggggttgtgcctactgaggtgacatatagctccattatcaatgcgctatgcaaagcaagagcaatggataaggcagagctgatccttcgacatatggttcatagtggtgtccaaccacatgataggatatataataccctgatccatgggtttttaacttcgggtcagcagaaagaagcctttaggttgttgaaactgatgacaagccaaggtgttatgccaaacgttgtgacttgcaactcagtcatggactacctttgcaagcatggaagagtcaaagaagctgcagaaatattttattccatggttgtgaagggccaaaaacctaatgtcatctcatactctgttatgctccacgggtatgctaaagaaggatcccttgttgctatgattgatctctgtgagctgatggcaagagatggagttgttcccgaccgctcttttttcaacatactgattaaggcatatgctaaatatggaatgatcgatgtggctatgcttttctttgatgaaatgttgaagcagggggtgaaccctaatgatatcacatatttaactctgatatctgcattttgcaagatgggcagaatggatgatgctatgatcaaattcaatgagatgattgatatgggaataccacatgatacaactgtttacatgtgcatgattgagggctatttgaatcatggtgattccgtcaaagccaaggaattcattactaaaatgaagagcagggatgtttctcatagcccacggaagggtaat

SEQ ID NO: 2778 - DNA, 702 bp, Triticum aestivum; identical to SEQ ID NO: 2776

SEQ ID NO: 2779 - DNA, 702 bp, Triticum aestivum; identical to SEQ ID NO: 2776

SEQ ID NO: 2780 - DNA, 840 bp, Triticum aestivum; identical to SEQ ID NO: 2777

SEQ ID NO: 2781 - DNA, 702 bp, Triticum aestivum; identical to SEQ ID NO: 2776

SEQ ID NO: 2782 - DNA, 678 bp, Triticum aestivum
atgccgccttcgccactgccacagagcgtgtctgccggcacgctcagtccgaagcacgtgcaccacctgttcgacaaattgcttcggcaggccactccggtccccgagcgctccctgaacggcttccttgccgccctcgcgcacgcgccggactcctccgcgtgcaaagacggccccgccctcgtcctcgccatcttcaaccgcgtctcccgagaagaagccggcctgcgggtggccacgcccgccatctgcacctactgcatcctcatggactgctgctgccgcgcgcgtcgccgggacctagggcttgccttcttcggccgcctcatgaggacgggcctcaagacaaaccagatcgccgccaacaacctcctcaagtgcctctgccacgcaaaacggaccgacgaggctgtcagcgtgctgcttcataggatgtccgacctcggttgtgcgcctaactgcatctcatacaacacagttctaaagagcttgtgcgaagatagcaggagccagcaagcgctcgacctgctccagatgatggcaaaagaaggaggtgtctgctcccctagtctggtcaaatataacacggtcatccacggcttcttcaaggaaggacaagtaagcaaggcatgcaatctataccatgaaatgatgagcaaggggttgtgcctgatgtgg

SEQ ID NO: 2783 - DNA, 789 bp, Triticum aestivum
atgcctcgccgcctctactccaccaggcccatgtcctacacccgtctctgccgccggttgtcctcctcctccaccaccacctcttcgtcgtcaccctcctggtgtccccatgccgccttcgccactgccacagagcgtgtccgtgccggcacgctcagtccggagcacgtgcaccacctgttcgacaaattgcttcggcaggccactccggtccccgagcgctccctgaacggcttccttgccgccctcgcgcacgcgccggactcctccgcgtgcaaagacggccccgccctcgtcctcgccatcttcaaccgcgtctcccgagaagaagccggcctgcgggtggccacgcccgccatctgcacctactgcatcctcatggactgctgctgccgcgcgcgtcgccgggacctagggcttgccttcttcggccgcctcgtgaggacgggcctcaagacaaaccagatcgccgccaacaacctcctcaagtgcctctgccacgcaaaacggaccgacgaggctgtcagcgtgctgcttcataggatgtccgacctcggttgtgcgcctaactgcatcttatacaacacagttctaaagagcttgtgcgaagatagcaggagccagcaagcgctcgacctgctccagatgatggcaaaagaaggaggtgtctgctcccctagtctggtcaaatataacacggtcatccacggcttcttcaaggaaggacaagtaagcaaggcatgcaatctataccatgaaatgatgagcaaggggttgtgcctgatgtgg

SEQ ID NO: 2784 - DNA, 789 bp, Triticum aestivum; identical to SEQ ID NO: 2783

SEQ ID NO: 2785 - DNA, 678 bp, Triticum aestivum; identical to SEQ ID NO: 2782

SEQ ID NO: 2786 - DNA, 678 bp, Triticum aestivum; identical to SEQ ID NO: 2782

SEQ ID NO: 2787 - DNA, 552 bp, Triticum aestivum
atgtcccgcgtctgcctctgccgccgcctctcctccacctccacctccaacacgccaccctcaccttcctggtcaccccaggccgcctttgccgcggccacggagcgcgcccgcgccggaacgctcagccctcaagacgcacaccacctgttcgacgaattgtttcggcaggccacaccggttcccgagcgctcccttgatggattccttgccgccctcggccgtgctgcgtcctctgaagcctgcagagacggcccctccctcgccctcactctcttcaaccgtctctgccgagaagaagccggccggcgggtggcgccgcccacaatctacacctacggcatcctgatgaactgctgctgccgcgtgcgtcgtccagacctagggctcgccttcttcggccgcctcctaaggaccggcctcaaaacaaatgaggtcgtcgccagcaccctcctcaagtgcctctgctgtgcaaaacgggcagatgaagctgtgaacgtgctgcttcataggatgtccgtcgctgtgtgcctaattccttctcatacaaca

SEQ ID NO: 2788 - DNA, 840 bp, Triticum aestivum
atgatacacggatattccacgttgggccggtggaaagaaacgggcaaaatgttcagagaaatgacaagccggggtatcataccagatgttgttagttggacctcattcatgacctccctctgcaagcatggaagaagcagagaagctactggaattattgattacatgtctgccaagggccacaagcctaatattgtctcgtactctattctgtttcatggatatgctacagaaggatgctttgatgatatgattaatctccttgactcaatggcaaccaacggtattgttcccaatcgccagattttcagcattttagttgatgcgtatgctaaacgtggaatgatggatgaagctatgctcatatttactggaatgtgggaacaaggagtgatcccagatgtatccagatggggacaaggagtgagtccagagtctacaatttttaggctggctgatgctttgaacaagttcagtcagatgatttctattgatataaaaccggacacagttgtttatcactccctaattcagggtttctgcacacatggcgatttggtgaaagcaaaggagttggtttatgaaatgataaacaaatacattccacctcctaccgttgtgttcttcagttcaataataaatagtctatgcaaagaaggaagggttacagatgcacaagatatcttcaacttggttgttgaaataggtgagagtcctgatgtctttgcttttacttcactacttgacagatattgcctagtcggcaaaatggagaaagcatcacaagttttgatgcaatggtatcagctggcattgagcctaatgcatccacctaaagcg

SEQ ID NO: 2789 - DNA, 840 bp, Triticum aestivum; identical to SEQ ID NO: 2788

SEQ ID NO: 2790 - DNA, 840 bp, Triticum aestivum; identical to SEQ ID NO: 2788

SEQ ID NO: 2791 - DNA, 840 bp, Triticum aestivum; identical to SEQ ID NO: 2788

SEQ ID NO: 2792 - DNA, 786 bp, Triticum aestivum
atgctcaggccagagctcgcgcaccaactgttcgacgaaatgctgcgccaacctgtcccagtatcagctcgtgcactcagcggcttatttgctgcacttgcgcgtgcgccgccctcacctgtgtgcaccgatagccctgccctcgccattgatctcttcaacctcatggcccgagcaggccgtcgccaggcaacaacacccaccatttacacctacatcatactaatggagtgttgccaccgagcatgccgcccagacctagggattgccttcttcggccgcctcctcaagacaggcatcccgacaaacatcattacctacagcagcttgttcaagtgcctctgtgacatgaagcgcacagaggaggctctgaacgtgctgctccataagatgcccgacgacctgcctaatgtcatctcctactcagtgattctcaagagcttctgcgacaatgggaggatccagcttgcgcttgatctgctccagatgatggccaaaaaaggcgctgaccactcccccgacgtgatgtcatacaacatggtaattgatggcttctttaaggagggtgaagtaagcaaagcatgcaatctattccaagaaatgatacgacaggggattgtgcctactgaggtgacatatagctccattatcaatgcgctatgcaaagcaagagcaatggacaaggcagaggtggttcttcgatcaatggttcataatggtgcccaaccagatgttgtgacatataatagcttgatccaaggatattcaactttgggacagttgaaa

SEQ ID NO: 2793 - DNA, 747 bp, Triticum aestivum
atgctgcgccaacctgtcccagtatcagctcgtgcactcagcggcttatttgctgcacttgcgcgtgcgccgccctcacctgtgtgcaccgatagccctgcccttgccattgatctcttcaactgcatggcccgagcaggccgtcgccaggcaacagcacccaccatttacacctacatcatactaatggagtgttgccatcgagcatgtcgcccagacctagggcttgccttcttcggccgcctcctcaagacaggcatcccgacaaacatcattacctacaacagcttgttcaagtgcctctgtgacatgaagcgcacagaggaggctctgaacgtgctcctccataagatgcccgacgacctgcctaatgtcatctcctactcagtgattctcaagagcttctgcgacaatgggaggatccagcttgcgcttgatctgctccagatgatggccaaaaaaggcgctgaccactcccccgacgtgatgtcatacaacatggtaattgatggcttctttaatgagggtgaagtaagcaaagcatgcaatctattccaagaaatgatacgacaggggattgtgcctactgaggtgacatatagctccattatcaatgcgctatgcaaagcaagagcaatggacaaggcagaggtggttcttcgatcaatggttcataatggtgcccaaccagatgttgtgacatataatagcttgatccaaggatattcaactttgggacagttgaaa

SEQ ID NO: 2794 - DNA, 786 bp, Triticum aestivum; identical to SEQ ID NO: 2792

SEQ ID NO: 2795 - DNA, 786 bp, Triticum aestivum; identical to SEQ ID NO: 2792

SEQ ID NO: 2796 - DNA, 747 bp, Triticum aestivum; identical to SEQ ID NO: 2793

SEQ ID NO: 2797 - DNA, 786 bp, Triticum aestivum; identical to SEQ ID NO: 2792

SEQ ID NO: 2798 - DNA, 837 bp, Triticum aestivum
atggactgttgctgccgcgcgtgccgcccggatctggcgctcgctttcttcggccgtctcttcaggacgggcctggaggcaaaccaagtcatcttctgcaccctcctcaagggactctgccacgcaaagcgcacagatgaggctctggacgtgctgcttcacaggatgcctgagctgggctgcactcccgatgtggtggcatataacaccgtcatccatggcttctttagggaaggccaagtaggcaaggcgtgcgatctgttccatggaatggcacagcagggcgttatgcccgatgtggtgacatatagctcggttattgatgcgctgtgcaaggccagagcaatggacaaagcagagtatttccttcgtcagatgattggtaatggtgtcgtacctaataatgtggcatataatagcctcatccatggatattcctcttcaggccattggaaggaggcagttagggtattcaaagagatgacaagtcggagggttacagcagatgtgcatacttacaacatgtttatgacctttctttgcaaacatggaagaagcaaagaagctgcaggaatttttgataccatggctatgaagggcctgaaacctgacaacgtttcatatgctattctccttcatgggtatgccaccgaaggatgcttagttgatatgattaatctcttcaattcaatggaaagagactgtattctacttgactgttgtatcttcagcatactgattaatgcatatgctaaatctgggaagcttgataaggcaatgcttttatttaaagaaatgcagaaacaaggagtgaatctgcattcacatattcaaccg

SEQ ID NO: 2799 - DNA, 837 bp, Triticum aestivum; identical to SEQ ID NO: 2798

SEQ ID NO: 2800 - DNA, 837 bp, Triticum aestivum; identical to SEQ ID NO: 2798

SEQ ID NO: 2801 - DNA, 837 bp, Triticum aestivum; identical to SEQ ID NO: 2798

SEQ ID NO: 2802 - DNA, 837 bp, Triticum aestivum; identical to SEQ ID NO: 2798

SEQ ID NO: 2803 - DNA, 837 bp, Triticum aestivum; identical to SEQ ID NO: 2798

SEQ ID NO: 2804 - DNA, 822 bp, Triticum aestivum
atgaaacagcgggggttcgtgcctgatgtggggacatataattccattattgatgcaatgtgcaaagcaagagcaatggacaaggcaaaattggtccttcgacaaatggttgatagtggggttcgaccggatattgtgacatataataaactgattcatggatattccatttcgggccagtttgaagaggtcgttacgttgttggaaaaaatgagaagtcaaggtgtcaaaccaactgtttttacttgcaacacagtcatggactacctttgcaagcatggaagaatcaaagaagctgcagaatttttttattccatggttgagaagggccataaacctaatatagtctcatatgctattatgcttcatgggtacgctaaagaaggatcccttgttgaaatgactgatctctgtgagctgatggcaagagatggtattgtatcctatctccattgtttcaacatactgattaatgcatatgctaagtgtggaatgatggatgtggctattcttttcttcaaagacatgttgaagcagggagtgaaccctgatgaagtcacatatttagcagtgatagctgggtattgcagagtgggcatgatggatgatgctatggaaaaattcaatgagatgatcggtatgggagtaccacataatgcaactgtttacaggtgcatgattcagggttacttaaatcatggtgatttcttgaaagcaaaggaattgattactgaaatgaagaccaagggtatccatcctagactgtcgaaaagccaaggaattgatccagggtacctcatgagtcaactgtttccaggtgca

SEQ ID NO: 2805 - DNA, 822 bp, Triticum aestivum; identical to SEQ ID NO: 2804

SEQ ID NO: 2806 - DNA, 822 bp, Triticum aestivum; identical to SEQ ID NO: 2804

SEQ ID NO: 2807 - DNA, 822 bp, Triticum aestivum; identical to SEQ ID NO: 2804

SEQ ID NO: 2808 - DNA, 822 bp, Triticum aestivum; identical to SEQ ID NO: 2804

SEQ ID NO: 2809 - DNA, 822 bp, Triticum aestivum; identical to SEQ ID NO: 2804

SEQ ID NO: 2810 - DNA, 849 bp, Triticum aestivum
atgccttgtgcaaggtcagggcaatggacaaggcaaagctggtccttcagcagatggttgataatggtgttcgaccaaatatgtatacatgcatggaactcattcatgtactccctttgcaagaatggaggaagcaaagaagctgcagaattttttgactccatgacctccaagggcctcaaacctaatatcgtcgtgtactctactcttcttcacgggtatgctactgaaggatgcctagccgatatgattaatctctttaattcaatgaaagacaatgctattgtagccaactgcaatgttttcaacatattaattgatgcatatgctaaacgtggaatgatgcatgaagctatgctcatatttactgaaatgcaggaacaaagagtgagtcctaatgtattcacctatgcaattgtaacagctgcactttgcagaatgggcaggctgtctgatgcaatggacaaactaaatgagatgattgcaatgggattacaaccgaacaaggttgtttatcattctctaattcagggtttttgtacacatggtgatttggtgaaagcaaaggccttggtttctgaaatgatgaacaaaggtattcctcgtccaaacattgtgttcttcagctcagtaataaacagtctatgcaaggaaggaagggttaccgaggcacacgatatcttcgacttggctataaacattggcgagaggcctaacgttattacatttagttcactgattgacggatattgtttagccgggaagatggataaagcattcggagtactagatgctaacacttttgagtatttcaaggaaaatatgtgcaagagaataagtagatggaag

SEQ ID NO: 2811 - DNA, 849 bp, Triticum aestivum; identical to SEQ ID NO: 2810

SEQ ID NO: 2812 - DNA, 849 bp, Triticum aestivum; identical to SEQ ID NO: 2810

SEQ ID NO: 2813 - DNA, 849 bp, Triticum aestivum; identical to SEQ ID NO: 2810

SEQ ID NO: 2814 - DNA, 849 bp, Triticum aestivum; identical to SEQ ID NO: 2810

SEQ ID NO: 2815 - DNA, 849 bp, Triticum aestivum
atgccttgtgcaaggtcagggcaatggacaaggcaaagctggtccttcagcagatggttgataatggtgttcgaccaaatatgtatacatgcatggaactcattcatgtaccccctttgcaagaatggaggaagcaaagaagctgcagaattttttgactccatgacctccaagggcctcaaacctaatatcgtcgtgtactctactcttcttcacgggtatgctactgaaggatgcctagccgatatgattaatctctttaattcaatgaaagacaatgctattgtagccaactgcaatgttttcaacatattaattgatgcatatgctaaacgtggaatgatgcatgaagctatgctcatatttactgaaatgcaggaacaaagagtgagtcctaatgtattcacctatgcaattgtaacagctgcactttgcagaatgggcaggctgtctgatgcaatggacaaactaaatgagatgattgcaatgggattacaaccgaacaaggttgtttatcattctctaattcagggtttttgtacacatggtgatttggtgaaagcaaaggccttggtttctgaaatgatgaacaaaggtattcctcgtccaaacattgtgttcttcagctcagtaataaacagtctatgcaaggaaggaagggttaccgaggcacacgatatcttcgacttggctataaacattggcgagaggcctaacgttattacatttagttcactgattgacggatattgtttagccgggaagatggataaagcattcggaatactagatgctaacacttttgagtatttcaaggaaaatatgtgcaagagaataagtagatggaag

SEQ ID NO: 2816 - DNA, 849 bp, Triticum aestivum; identical to SEQ ID NO: 2810

SEQ ID NO: 2817 - DNA, 762 bp, Triticum aestivum
atggtctcagytggcttgagacctgacagtttttcttatgatacattgcttaatggctattgtaaagctggcaggatagataatgcatgttgtctttwmygagaaatgttgakgmmkggagttrygmctkrmratrmkacttacaatactatactgaatggcttgtttaggagtgggagattttctgaagcaagggaactctacgtcaatatgattaaaagtaggaaactgtggtccatttgcacatacagtataattcttgatgggttttgcaaaaacaattgttttgatgaagcattcaaaatatttcagagcctctgttctatggatcttcaacttgacataattacttttaacatcatgattgatggtttgttcaaaggtggcagaaaggaagatgccatggatttgttygctactatctctgcttatggtttggttccagatgttgtgacctaccgcttaatagcagaaaatctcatagaagaagggtcgctaggggagtttgatggtctgttttcagcaatggaaaagagtggtactgctccaaactcacatatgttaaatgctctagttaggaggttgttgcatagaggtgacataagcagggctggggtttacctctacaaacttgatgagaagaatttttcacttgaggcttccactacttccatgcttatatcactttactcgaggggtgaatatcagccacatgcaaagtcgctgcctgaaaagtatcgtttcctcattgaagccaacagt

SEQ ID NO: 2818 - DNA, 558 bp, Triticum aestivum
atgccccgcattcccctctgcaactccaccatgcccatgtcccgcatcggcctccgccgccgccgactttcctcctccttctccacctccacctccaccgcgcgatcctcacggtcatggtctccccacgccgcatttgccgcggccacggagcgcgtccgcgccgggacgctcagcccggaggacgcacaccacctgttcgaccaattgctacggcaggacactccggtccaggagcgctccctgggcggcttccttgccgccctcgcccgtgcgccagactcagcttcctgcagagatggcccctccctcgccctctccctcttcaaccgcgtatgccgagaagaagcaggccggcgggtggcgccgcccacagcctacacctacgccatcctgatgaactgctgctgccgcgtgcgtcgtccagacctagggcttgccttatttggccgcctcctaaggacaggcctcaaaacaaatgagatcgtcgccaacaccctcctcaagtgcctcttgctgcgcaaaacggacagacgaggctgtcagcgtgctgcttca

SEQ ID NO: 2819 - DNA, 558 bp, Triticum aestivum; identical to SEQ ID NO: 2818

SEQ ID NO: 2820 - DNA, 669 bp, Triticum aestivum
atgccccgcattcccctctgcaactccaccatgcccatgtcccgcatcggcctccgccgccgccgactttcctcctccttctccacctccacctccaccgcgcgatcctcacggtcatggtctccccacgccgcatttgccgcggccacggagcgcgtccgcgccgggacgctcagcccggaggacgcacaccacctgttcgaccaattgctacggcaggacactccggtccaggagcgctccctgggcggcttccttgccgccctcgcccgtgcgccagactcagcttcctgcagagatggcccctccctcgccctctccctcttcaaccgcgtatgccgagaagaagcaggccggcgggtggcgccgcccacagcctacacctacgccatcctgatgaactgctgctgccgcgtgcgtcgtccagacctagggcttgccttatttggccgcctcctaaggacaggcctcaaaacaaatgagatcgtcgccaacaccctcctcaagtgcctctgctgcgcaaaacggacagacgaggctgtcagcgtgctgcttcataggatgtccaagctaagcttggttgtgtgcctgatgccatctcatacaacacagttcttaagagcttatgtgataatagcagcagccagcgggcgctcgacctccttcaga

SEQ ID NO: 2821 - DNA, 669 bp, Triticum aestivum; identical to SEQ ID NO: 2820

SEQ ID NO: 2822 - DNA, 558 bp, Triticum aestivum; identical to SEQ ID NO: 2818

SEQ ID NO: 2823 - DNA, 558 bp, Triticum aestivum; identical to SEQ ID NO: 2818

SEQ ID NO: 2824 - DNA, 678 bp, Triticum aestivum; identical to SEQ ID NO: 2782

SEQ ID NO: 2825 - DNA, 411 bp, Triticum aestivum
atgccgagaagaagctggcccgcgggtggcgcagcccacaatcttcacctacggcgtcctcatgaactgatgcgtccgcactcgtccgcactcgggcttgttttcttcggccgtctcctcaggaggggcctgaagacaaacacgattgtcttcagctccctcctcaagtgcctctgtcacgccaaacggacagacgaggctgtcagcgtgctgcttcataggatgtctgagcttggttgtgtgcctgatgccttctcatacaccattgttcttaagagcttatgtgatggtagcagcagccagcgggcgctcgacctgctccagatgatggagaaaggagaaggtgtctgctctcccctggcgtggtgttatataccacggtcatccacggcctccttaaggaaggggaag

SEQ ID NO: 2826 - DNA, 411 bp, Triticum aestivum; identical to SEQ ID NO: 2825

SEQ ID NO: 2827 - DNA, 765 bp, Triticum aestivum
atgttggatcgcggcatctgtcccgacacagtgttcttcaacacaattatggaccgcctttgcaaaaatgaaagggttatggaagcccaagatctcttcgacctgatggtacacatgggtgtgaagcctgatgtatgtacttataacacactgataggtggatacttgtttgttggtaagatggatgaagtgagcaagttacttgacaatatggtctcaattggcatggaaccagatgttatcacctataacatactgattgatggttactctaagaatggaaagatagatgatgcattggttgtttttagggggatattggaaaggaaggataagccttctgttatcacttttaatattatgattggtgcgttgcttaaatgtcgcaggaaggaagaagcaaaagatttgtttgacggtatctgggccaaaggattagttcctgatgttgttacatatagcttaatgatacaaaaacttatagaagaaggttctctacaggagtctgatgatctattcctttctatggagaagaatggttatcctgccaattcctgcatgctaaatgctatagttagaaggttacttcagaaaggggagatgcccagggctgggacttatttgtctaaaattgatgagaggaatttcacccttgaagcttccacaactagcttgttgactgcacttgcttcagtggggaaatgtcaggaatataaggggttactgcctgaaaaatatcattgttttctggaacagggcactgat

SEQ ID NO: 2828 - DNA, 765 bp, Triticum aestivum; identical to SEQ ID NO: 2827

SEQ ID NO: 2829 - DNA, 765 bp, Triticum aestivum; identical to SEQ ID NO: 2827

SEQ ID NO: 2830 - DNA, 765 bp, Triticum aestivum; identical to SEQ ID NO: 2827

SEQ ID NO: 2831 - DNA, 765 bp, Triticum aestivum; identical to SEQ ID NO: 2827

SEQ ID NO: 2832 - DNA, 765 bp, Triticum aestivum; identical to SEQ ID NO: 2827

SEQ ID NO: 2833 - DNA, 780 bp, Triticum aestivum
atgaactattttctgagatgttggatcgcggcatttgtcccaacagtgttcttcaacacaattatggaccgcctttgcaaaaatgaaagggttatggaagcccaagatctcttcgacctgatggtacacatgggtgtgaagcctgatgtgtgtaattataacacactgataggtggatacttgttcgatggtaagatggatgaagtgaggaagttacttgacaatatggtctctattggcttgaaaccagatgttatcacatataccatactgattgatggttactctaagaatggaaggatagatgatgcattggttgtttccagggaaatgttggccgggaacgttaagccttgtgttatcactttgaatattatgattggtgcgttgcttaaaggtggcaggaaggaagaggctaaagatttgtttgatggtatctgggccaaaggattagtgcccaccgttgttacatatagcttaatgatacaaaaacttatagaagaaggttctctacaagagtcggatgatctattcctttctatggagaagaatggatgtgctgccgactcccatatgctaaatgctatagttagaagcttacttcggaaaggggaggtgcccagggctgggacttatctgtctaaaattgatgagaggaggttcacccttgaagcttccacagctagcttgttggctgcagttgcgtcaggggggaaaggccaggaatataaggagttactccccgaaaaataccactattttctggaacagggcactgat

SEQ ID NO: 2834 - DNA, 780 bp, Triticum aestivum; identical to SEQ ID NO: 2833

SEQ ID NO: 2835 - DNA, 780 bp, Triticum aestivum; identical to SEQ ID NO: 2833

SEQ ID NO: 2836 - DNA, 780 bp, Triticum aestivum; identical to SEQ ID NO: 2833

SEQ ID NO: 2837 - DNA, 780 bp, Triticum aestivum; identical to SEQ ID NO: 2833

SEQ ID NO: 2838 - DNA, 780 bp, Triticum aestivum; identical to SEQ ID NO: 2833

SEQ ID NO: 2839 - DNA, 681 bp, Triticum aestivum
atgtccgacctcggctgtgtgcctaactgcatctcacacggcatagttctaaagagcttgtgcgaagatagcaggagccagcaagcgctcgacctgctccggatgatggcaaaagaaggaggtgcctgctcccctagtctggtcacatataacacggtcatccacggcttcttcaaggaaggacaagtaagcaaggcatgcaatctataccatgaaatgatgcagcaaggggttgtgcctgatgtggtgacgtataactcgattattgatgcgctgtgcaaggccagagctatgggcaaggcagagttgttcctaaggcagatggttgataacggtgttcgaccagataacgtgacatatactgcagtaatccatggatattccactttgggccagtggaaaaaggcggctaaaatgtttagagaaatgacaagcctcggtcttgtaccaaatactgtcacttggaactcatccatggcctccctctgcaagcatggaagaagcaaagaagctgcagaaatttttcattccatggctgcgaagggccacaagcctgatgtcgtctcgtatcgtgttctgctccaagggtatgctacagagggtgctttgcagatatggttgatctctataattcaatgtcaagcaatggtattgtacccaatcgccaggttttcaacatat

SEQ ID NO: 2840 - DNA, 681 bp, Triticum aestivum; identical to SEQ ID NO: 2839

SEQ ID NO: 2841 - DNA, 816 bp, Triticum aestivum
atgtcatgtgtatacctgaaaaactttcctgctgcacacgttcaacaccgccaccaaaacggcaggacaactgacccgcgatcaatttgccacttcccagaccaggcgcgtcctccccacccccgacggctcacgcgccgccgccgccgccgccgccgccgctcctcctcctccacatccacctacccgcaaccgccaggtgtccagcttccgcctccacctccgcaactccttctctcccaccccgcccatgtgaccatgttccgcatgcgcctccgcaactcctccaccatgcccatgtcccgcatcggcctcctcctccgccgcctctcctcctcctcctcctcctcctacttctccacctccacctcgccaccctcacggtcacggtcatggtctccccgcgacgcctttgccgcggccacggagcgcgtccgtgccgggacgctcagcccggaggacgcacaccacctgtttgaccaattgctacggcaggacactccggtccacgagcgctccctgggcggcttccttgccgccctcgcccgtgcgccagactcggctgcctgcagagatggccccgccctcgccatcgccctcttcaaccgcgtatgccgagaagaagcaggcaggccggtggtgccgcccacagtctacacctacgccatcctgatgaactgctgctgccgcgtgcgtcgtccggacctagggcttgccttatttggccgcctcctaaggacaggcctcaaacaaatgagatcgtcgccagcaccgtcctcaagtgcctctgctgcgcaaaacggacagatgaagcag

SEQ ID NO: 2842 - DNA, 816 bp, Triticum aestivum
atgtcatgtgtatacctgaaaaactttcctgctgcacacgttcaacaccgccaccaaaacggcaggacaactgacccgcgatcaatttgccacttcccagaccaggcgcgtcctccccacccccgacggctcacgcgccgccgccgccgccgccaccgccgctcctcctcctccacatccacctacccgcaaccgccaggtgtccagcttccgcctccacctccgcaactccttctctcccaccccgcccatgtgaccatgttccgcatgcgcctccgcaactcctccaccatgcccatgtcccgcatcggcctcctcctccgccgcctctcctcctcctcctcctcctcctacttctccacctccacctcgccaccctcacggtcacggtcatggtctccccgcgacgcctttgccgcggccacggagcgcgtccgtgccgggacgctcagcccggaggacgcacaccacctgttcaaccaattgctacggcaggacactccggtccacgagcgctccctgggcggcttccttgccgccctcgcccgtgcgccagactcagctgcctgcagagatggccccgccctcgccatcgccctcttcaaccgcgtatgccgagaagaagcaggccggccggtggtgccgcccacagtctacacctacgccatcctgatgaactgctgctgccgcgtgcgtcgtccggacctagggcttgccttatttggccgcctcctaaggacaggcctcaaacaaatgagatcgtcgccagcaccgtcctcaagtgcctctgctgcgcaaaacggacagatgaagcag

SEQ ID NO: 2843 - DNA, 816 bp, Triticum aestivum; identical to SEQ ID NO: 2842

SEQ ID NO: 2844 - DNA, 816 bp, Triticum aestivum
atgtcatgtgtatacctgaaaaactttcctgctgcacacgttcaacaccgccaccaaaacggcaggacaactgacccgcgatcaatttgccacttcccagaccaggcgcgtcctccccacccccgacggctcacgcgccgccgccgccgccgccaccgccgctcctcctcctccacatccacctacccgcaaccgccaggtgtccagcttccgcctccacctccgcaactccttctctcccaccccgcccatgtgaccatgttccgcatgcgcctccgcaactcctccaccatgcccatgtcccgcatcggcctcctcctccgccgcctctcctcctcctcctcctcctcctacttctccacctccacctcgccaccctcacggtcacggtcatggtctccccgcgacgcctttgccgcggccacggagcgcgtccgtgccgggacgctcagcccggaggacgcacaccacctgttcgaccaattgctacggcaggacactccggtccacgagcgctccctgggcggcttccttgccgccctcgcccgtgcgccagactcagctgcctgcagagatggccccgccctcgccatcgccctcttcaaccgcgtatgccgagaagaagcaggccggccggtggtgccgcccacagtctacacctacgccatcctgatgaactgctgctgccgcgtgcgtcgtccggacctagggcttgccttatttggccgcctcctaaggacaggcctcaaacaaatgagatcgtcgccagcaccgtcctcaagtgcctctgctgcgcaaaacggacagatgaagcag

SEQ ID NO: 2845 - DNA, 816 bp, Triticum aestivum
atgtcatgtgtatacctgaaaaactttcctgctgcacacgttcaacaccgccaccaaaacggcaggacaactgacccgcgatcaatttgccacttcccagaccaggcgcgtcctccccacccccgacggctcacgcgccgccgccgccgccgccgccgccgctcctcctcctccacatccacctacccgcaaccgccaggtgtccagcttccgcctccacctccgcaactccttctctcccaccccgcccatgtgaccatgttccgcatgcgcctccgcaactcctccaccatgcccatgtcccgcatcggcctcctcctccgccgcctctcctcctcctcctcctcctcctacttctccacctccacctcgccaccctcacggtcacggtcatggtctccccgcgacgcctttgccgcggccacggagcgcgtccgtgccgggacgctcagcccggaggacgcacaccacctgtttgaccaattgctacggcaggacactccggtccacgagcgctccctgggcggcttccttgccgccctcgcccgtgcgccagactcagctgcctgcagagatggccccgccctcgccatcgccctcttcaaccgcgtatgccgagaagaagcaggcaggccggtggtgccgcccacagtctacacctacgccatcctgatgaactgctgctgccgcgtgcgtcgtccggacctagggcttgccttatttggccgcctcctaaggacaggcctcaaacaaatgagatcgtcgccagcaccgtcctcaagtgcctctgctgcgcaaaacggacagatgaagcag

SEQ ID NO: 2846 - DNA, 816 bp, Triticum aestivum; identical to SEQ ID NO: 2842

SEQ ID NO: 2847 - DNA, 564 bp, Triticum aestivum
atgctccatgagatggtcgaatgcggaacaacagtgagcttgtccacatacaacataattcttgggggactttgtagaaatgattgcaccgacgaagcaatcgtcctatttcagaaattaggtgcaatgaatgtgaaattggatatcacaacactcaataccatgattgatgcaatgtacaaggttcgtagaagacaagaagctaaagatttgtttgctgcaatatcagccagtggcttggtacctaattctcctacttacggcacaatgatacaaagtctacaaaaagaaggattaatggaagaagctgacaatatcttctcatcaatggagaagagtggctgtgttctgagctctcgtcttttaaatgatatcatcagaacattactggaaaagggggagattctaaaggccggaaattatatgtctaaaattgatgggaagaacgcccaacttgaagcttcaactagttcgttgttgttgtctctgttttcaggggaaggggaatctcgggaacaaatacagttgctccctgtaaagtaccaattcttcgatgcagttagt

SEQ ID NO: 2848 - DNA, 564 bp, Triticum aestivum
atgctccatgagatggtcgaatgtggaacaacagtgagcttgtccacatacaacataattcttggaggactttgtagaaatgattgcaccgacgaagcaatcgtcctatttcagaaattaggtgcaatgaatatgaaattggatatcacaacactcaataccatgattgatgcaatgtacaaggttcgtagaagacaagaagctaaagatttgtttgctgcaatatcagccagtggcttggtacctaattctcctacttacggcacaatgatacaaagtctactaaaagaaggattaatggaagaagctgacaatatcttctcgtcaatggagaagagtggctgtgttctgagctctcgtcttttaaatgatatcatcagaacattactggaaaagggagagattctaaaggccggaaattatatgtctaaaattgatgggaagaacgcccaacttgaagcttcaactagttcgttgttgttgtctctgttttcaggggaagggaaatatcgggaacaaatacagttgctccctgtaaagtaccaattcttcgatgcagttagt

SEQ ID NO: 2849 - DNA, 564 bp, Triticum aestivum; identical to SEQ ID NO: 2847

SEQ ID NO: 2850 - DNA, 564 bp, Triticum aestivum; identical to SEQ ID NO: 2847

SEQ ID NO: 2851 - DNA, 564 bp, Triticum aestivum; identical to SEQ ID NO: 2847

SEQ ID NO: 2852 - DNA, 564 bp, Triticum aestivum; identical to SEQ ID NO: 2847

SEQ ID NO: 2853 - DNA, 564 bp, Triticum aestivum; identical to SEQ ID NO: 2847

SEQ ID NO: 2854 - DNA, 666 bp, Triticum aestivum
atgtccgagctcggttgtgtgcctgatgccttctcttacaccattgttcttaagatcttatgtgatgctagcagcagccagtgggcgctcgacctgctccagactatggagaaaggaggaggtgtctgctcccctgacgtggtgtcatataccacggtcatccacaacctccttaaggaaggggaagtaagcaaggcatgcaatctataccatgaaatggtgcagcaaggggttgtgcctgatgtgaggacatatagctcgattattaatgcgctatgcaaggccgaagcaatggacaaggcagagttgttccttcgtcagatggttgataagggtgttcggccgaataacaagacatatactagcataatccatggatattccacgttgggccggtggaaagaagctggcaaaatgttcagagaaatgacaagccagggtatcataccagatgttgttacttggacctcattcatggcctccttctgcaagcatggaagaagcagagaagctgccaaaatttttgattacatgtcttccaggggacacaagcctaatgtcgtctcatattctattttgtttcatggatatggtatagaaggatgctttgctgatatgattaatctccttaattcaatggcaaacaacggtattgttcccaatcgc

SEQ ID NO: 2855 - DNA, 666 bp, Triticum aestivum
atgtccgagctcggttgtgtgcctgatgccttctcttacaccattgttcttaagatcttatgtgatgctagcagcagccagtgggcgctcgacctgctccagactatggagaaaggaggaggtgtctgctcccctgacgtggtgtcatataccacggtcatccacaacctccttaaggaaggggaagtaagcaaggcatgcaatctataccatgaaatggtgcagcaaggggttgtgcctgatgtgaggacatatagctcgattattaatgcgctatgcaaggccgaagcaatggacaaggcagagttgttccttcgtcagatggttgataagggtgttcggccgaataacaagacatatactagcataatccatggatattccacgttgggccggtggaaagaagctggcaaaatgttcagagaaatgacaagccagggtatcataccagatgttgttacttggacctcattcatggcctccttctgcaagcatggaagaagcagagaagctgccaaaaattttgattacatgtcttccaggggacacaagcctaatgtcgtctcatattctattttgtttcatggatatggtatagaaggatgctttgctgatatgattaatctccttaattcaatggcaaacaacggtattgttcccaatcgc

SEQ ID NO: 2856 - DNA, 666 bp, Triticum aestivum; identical to SEQ ID NO: 2854

SEQ ID NO: 2857 - DNA, 666 bp, Triticum aestivum
atgtccgagctcggttgtgtgcctgatgccttctcttacaccattgttcttaagatcatatgtgatgcttgcagcagccagtgggcgctcgacctggtccagactatggagaaaggaggaggtgtctgctcccctgacgtggtgtcatataccacggtcatccacgacctccttaaggaaggggaagtaagcaaggcatgcaatctataccatgaaatggtgcagcaaggggttgtgcctgatgtgaggacatatagctcgattattaatgcgctatgcaaggccgaagcaatggacaaggcagagttgttcctttgtcagatggttgataatggtgttcggccgaataacaagacatatactagcataatccatggatattccacgttgggccggtggaaagaagctggcaaaatgttcagagaaatgacaagccagggtatcataccagatgttgttacttggacctcattcatggcctccttctgcaagcatggaagaagcagagaagctgccaaaatttttgattacatgtcttccaggggacacaagcctaatgtcgtctcatattctattctatttcatggatatggtacagaaggatgctttgctgatatgattaatctccttaattcaatggcaaacaacggtattgttcccaatcgc

SEQ ID NO: 2858 - DNA, 666 bp, Triticum aestivum; identical to SEQ ID NO: 2857

SEQ ID NO: 2859 - DNA, 666 bp, Triticum aestivum; identical to SEQ ID NO: 2854

SEQ ID NO: 2860 - DNA, 516 bp, Triticum aestivum
atggactgctgctgccgtgcgcgtcgcccggagctagggcttgccttattcgtccgcgtcctcaggaagggcctaaagacaaaccagatcgtcgcgaacaccttcctcaagtgcctctgctatgcgaaaaggacggatgaggctgtgaacgtgctgcttcataggatgtccgagctcggctgtgtgccagatgccttctcatacaacattgttctgaagatcttctgcgacaatagcatgagccagcgagggctcgaacttctccagatgatggcgaaagaaggaggtggctgcttccctgatatggtggcatataacacggtcatccatggcctctttaaggagggtgaaataggcaaggcatgcaatctattccatgaaatggtgcagcaaggtgttgtgcctggtgtggtgacatatagctcgattattgacgcgctgtgcaaggccagagcaatggacaaggcagagctagtccttcggcagatggttgccaatggtgctcaacccaatcaa

SEQ ID NO: 2861 - DNA, 516 bp, Triticum aestivum; identical to SEQ ID NO: 2860

SEQ ID NO: 2862 - DNA, 516 bp, Triticum aestivum; identical to SEQ ID NO: 2860

SEQ ID NO: 2863 - DNA, 516 bp, Triticum aestivum; identical to SEQ ID NO: 2860

SEQ ID NO: 2864 - DNA, 567 bp, Triticum aestivum
atgagaagccaaggtgttatgccaaatgttgttacctgcaactcagtcatgacctaccattgcaagaatggaagagtcaaagaagctgcagaaatattttattccatggctgtgaacggccgaaaacctgatgtcatctcatactctattatgctccacgggcacgcgacagaaggatccattgttgaaatgattgatctctgtgagctgatggcaagagacggagttgtacccaaccgctctgttttcaacatactgattaaggcatatgctaagtatggcatgatggatgtggccatgcttttcttcgaagacatgttgaagaagggggtgaaccctaatgaagtcacttatttaaccgtgatatctgcattttgcaagatgggcaggatggatgatgcgatggaaaaattcaatgagatgattgatatgggagtaccacttgacacagaagtttacatgtgcatggttgagggttattttaatcatgatgattccatgaaagcggaggaatttattactaaaatgaagagcagggatatttttcataggccgcggaagggtaat

SEQ ID NO: 2865 - DNA, 567 bp, Triticum aestivum; identical to SEQ ID NO: 2864

SEQ ID NO: 2866 - DNA, 567 bp, Triticum aestivum; identical to SEQ ID NO: 2864

SEQ ID NO: 2867 - DNA, 567 bp, Triticum aestivum; identical to SEQ ID NO: 2864

SEQ ID NO: 2868 - DNA, 567 bp, Triticum aestivum; identical to SEQ ID NO: 2864

SEQ ID NO: 2869 - DNA, 567 bp, Triticum aestivum; identical to SEQ ID NO: 2864

SEQ ID NO: 2870 - DNA, 759 bp, Triticum aestivum
atgagccgccgcgtcgtccccgttggcaggcgcatcttggagcagaacatcaaggctcggtaccacgccagagacattggcaccgaggatgcactccacctgtttgacgaattgctcccgtatgctgggcgctcctccatccatgccatcaactgcctcctcaccgttgtcggccgtgattgccctgcgctcggcgcctccctcttcaaccgcgtcgcaaggtccaaggtggcacccagcagtatcacctatgccattctggtcgactgctgctgccgcgctggccgccaggaccttggacacactgccatgggacaggtcatcaagatggggtttcttgcagatgctatgatcactttcagccacctactcaaggccatctgtgcggagaacaagaccagctatgcaatggacatcctactccgaataatgcccatgtttaactgcgtaccggatgtcatctcctacaacattcttttcaagggtgactgcaacgagaagagaagccaagaggctctcgagctgattcaggtgatggttgagcatggaggtggctgccaacctactgtggtgtcctatagcaccgtaattgatggcttgttgaaagagggtgaggtgaacaaggcttacagcctattttgtcaaatgttacaaaggggaatttcaccggatgttgtgacctgtagttcaattatttctggcatgtgcaagcttcatgcgatggacaaggctgaggaggttcttcaacagatgcttgat

SEQ ID NO: 2871 - DNA, 759 bp, Triticum aestivum; identical to SEQ ID NO: 2870

SEQ ID NO: 2872 - DNA, 759 bp, Triticum aestivum; identical to SEQ ID NO: 2870

SEQ ID NO: 2873 - DNA, 627 bp, Triticum aestivum
atggactgctgctgccgtgtgcgtcgcccgaagctagtgcttaccttattcagcctattcctgatgaaaggcctgaagacaaaccagatcattgtcaacaccttcctcaagtgcctctgctatgcgaaaaggacggacgaggctgtgaatgtgctgcttcataggatggctgagctcgtctgcgtgcctaatgccttctcatacaacattgttctgaagagcttctgcgactatagcatgagccaacgggcgctcgaactgctccagatgatcgcgaaagaaggaggtggctgcttccctgatgtggtggcatataacacggtcatccatggcctctttatggagggcgaaacaggcaaggcatgcaatctattccatgaaatggtgcagcaagatgttgcgcccagtgtggtgacatatatctcgattattgacgctttgtgcaaggccagagcaatggagaaggcagagctagtcctttggcagatggttgctaatggtgctcatcccgatacaatgacatatagttgcatgatcaatggatattccacatctgggcggttgaaagaggccactaaattgttaagagaaatgacaggccggggtcttataccagatattgttact

SEQ ID NO: 2874 - DNA, 777 bp, Triticum aestivum
atggactgctgctgccgtgtgcgtcgcccgaagctagtgattaccttattcagcctcttcctgatgaaaggcctgaagacaaaccagatcattgtcaacaccttcctcaagtgcctctgctatgcgaaaaggacggacaaggctgtgaatgtgctgcttcataggatgtctgagctcggctgcgtgcctaatgccttctcatacaacattgttctgaagagctcctgcgactatagcatgagccaacgggcgctcgaactgctccagatgatcgcggaagaaggaggtggctgcttccctgatgtggtggcatataacacggtcatccatggcctctttatggagggcgaaacaggcaaggcatgcaatctattccatgaaatggtgcagcaagatgttgcgcccagtgtggtgacatatatctcgattattgacgctttgtgcaaggccagagcaatggagaagacagagctagtcctttggcagatggttgctaatggtgctcatcctgatacaatgacatatagttgcatgatcaatggatattccacatctgggcggttgaaagaggccactaaattgttaagagaaatgacaggccggggtcttataccagatattgttacttgcaactcgttcctggcctccctttgcaagcttggaagaagcaaagaagctgcagaattttttgaatccatgactgccaagggccacaaaactggatatcgtctcataccacattttgcttcatgggtatgctaccgaaggatgctttgc

SEQ ID NO: 2875 - DNA, 762 bp, Triticum aestivum
atggactgctgctgccgtgtgcgtcgcccgaagctagtgcttaccttattcagcctcttcctgatgaaaggcctgaagacaaaccagatcattgtcaacaccttcctcaagtgcctctgctatgcgaaaaggacggacaaggctgtgaatgtgctgcttcataggatgtctgagctcggctgcgtgcctaatgccttctcatacaacattgttctgaagagcttctgcgactatagcatgagccaacgggcgctcgaactgctccagatgatcgcgaaagaaggaggtggctgcttccctgatgtggtggcatataacacggtcatccatggcctctttatggagggcgaaacaggcaaggcatgcaatctattccatgaaatggtgcagcaagatgttgcgcccagtgtggtgacatatatctcgattattgacgctttgtgcaaggccagagcaatggagaaggcagagctagtcctttggcagatggttgctaatggtgctcatcctgatacaatgacatatagttgcaagatcaatggatattccacatttgggcggttgaaagaggccactaaattgttaagagaaatgacaggccggggtcttataccagatattgttacttgcaactcgttcctggcctccctttgcaagcttggaagaagcaaagaagctgcagaattttttgaatccatgactgccaagggccacaaaactggatatcgtctcataccacattttgcttcatgggtatgctac

SEQ ID NO: 2876 - DNA, 762 bp, Triticum aestivum
atggactgctgctgccgtgtgcgtcgcccgaagctagtgcttaccttattcagcctcttcctgatgaaaggcctgaagacaaaccagatcattgtcaacaccttcctcaagtgcctctgctatgcgaaaaggacggacaaggctgtgaatgtgctgcttcataggatgtctgagctcggctgcgtgcctaatgccttctcatacaacattgttctgaagagcttctgcgactatagcatgagccaacgggcgctcgaactgctccagatgatcgcgaaagaaggaggtggctgcttccctgatgtggtggcatataacacggtcatccatggcctctttatggagggcgaaacaggcaaggcatgcaatctattccatgaaatggtgcagcaagatgttgcgcccagtgtggtgacatatatctcgattattgacgctttgtgcaaggccagagcaatggagaaggcagagctagtcctttggcagatggttgctaatggtgctcatcctgatacaatgacatatagttgcatgatcaatggatattccacatctgggcggttgaaagaggccactaaattgttaagagaaatgacaggccggggtcttataccagatattgttacttgcaactcgttcctggcctccctttgcaagcttggaagaagcaaagaagctgcagaattttttgaatccatgactgccaagggccacaaaactggatatcgtctcataccacattttgcttcatgggtatgctac

SEQ ID NO: 2877 - DNA, 777 bp, Triticum aestivum; identical to SEQ ID NO: 2874

SEQ ID NO: 2878 - DNA, 762 bp, Triticum aestivum; identical to SEQ ID NO: 2876

SEQ ID NO: 2879 - DNA, 537 bp, Triticum aestivum
atggactgctgctgccgcgcgcgtcgccctgacctggggcttgccttcttcggccgcctcctcaggacgggcctgaggacagacggcatcgacgcatacgccctcatcaggtgcttttgcctcgcaaaacggacagacaaggctgtcagcgtgctgctccataggatgcctgaactcggctgtgcgcctgatgccttgtcatactccgtcgttctgaaggtcttgtgtgacgatggcaggagccagcgagcgcttgacctgccccagatgatgtcgaaagaaggaggtggctgcgcccccaacgtggtggcatatagcacggtcatccatggcttctgtaaggaaggcgaagtaagcaaggcatgcgatctgttcaatgaaatggagcatcaaggagttaaacctaatgtggtgacatatacctcgataattgatgcgctgtgcaaggccagagcaatggacaaggcagagtcgttccttcggcagatggtcgataatgatgttcgacccaacaacgtggcatataagtgtatgatc

SEQ ID NO: 2880 - DNA, 537 bp, Triticum aestivum; identical to SEQ ID NO: 2879

SEQ ID NO: 2881 - DNA, 537 bp, Triticum aestivum; identical to SEQ ID NO: 2879

SEQ ID NO: 2882 - DNA, 537 bp, Triticum aestivum; identical to SEQ ID NO: 2879

SEQ ID NO: 2883 - DNA, 537 bp, Triticum aestivum; identical to SEQ ID NO: 2879

SEQ ID NO: 2884 - DNA, 537 bp, Triticum aestivum; identical to SEQ ID NO: 2879

SEQ ID NO: 2885 - DNA, 537 bp, Triticum aestivum; identical to SEQ ID NO: 2879

SEQ ID NO: 2886 - DNA, 729 bp, Triticum aestivum
atgtcaagcctccgcgtcctccgccgcagctccacctccacctccacctccacctcgccgccctcgcgctcctggtctcccaccgcagcctttgccgcggccacagagcgtgtccgcgccgggacgctcagccaagatgatgcacaccacctgttcgacgaattgctgcggcaggtcaccccggtccccgagcgccccctcaacggcttcctcgccgccctcgcacgtgctacgtcctctgccgcctgcatcagagatggtcccgccctcgacgtcgccctcttcaaccgcgtgtgccgagaacaagccggcccgcgggtggcgcctctcacagtccacacgtacaacatcctcatggactgctgctgccgcgcgtctcgcccggacctaggtcttgccttcttcgctcgcctcctcaggacaggcctgaagacagatgagatcaccgccaacaccttcctcaagtgcctctgctacgcaaaacggacggatgaggctgtgaacgtgctgcttcataggatgtccgagcttggctgtgtgcctaatgccttctcatactccattgttctgaagagcttatgcgacaatagcatgagtcagcgggcgctcgacctgctccagatgatggcgaaagaaggaggtgcctgctcccccaacgtggtggcatatagcacggtcatccatggcttcttaggaaggcgaaacaggcaaggcatgcaatctgttcca

SEQ ID NO: 2887 - DNA, 729 bp, Triticum aestivum; identical to SEQ ID NO: 2886

SEQ ID NO: 2888 - DNA, 729 bp, Triticum aestivum; identical to SEQ ID NO: 2886

SEQ ID NO: 2889 - DNA, 729 bp, Triticum aestivum
atgtcaagcctccgcgtcctccgccgcagctccgcctccacctccacctccacctcgccgccctcgcgctcctggtctcccaccgcagcctttgccgcggccacagagcgtgtccgcgccgggacgctcagccaagatgatgcacaccacctgttcgacgaattgctgcggcaggtcaccccggtccccgagcgccccctcaacggcttcctcgccgccctcgcacgtgctacgtcctctgccgcctgcatcagagatggtcccgccctcgacgtcgccctcttcaaccgcgtgtgccgagaacaagccggcccgcgggtggcgcctctcacagtccacacgtacaacatcctcatggactgctgctgccgcgcgtctcgcccggacctaggtcttgccttcttcgctcgcctcctcaggacaggcctgaagacagatgagatcaccgccaacaccttcctcaagtgcctctgctacgcaaaacggacggatgaggctgtgaacgtgctgcttcataggatgtccgagcttggctgtgtgcctaatgccttctcatactccattgttctgaagagcttatgcgacaatagcatgagtcagcgggcgctcgacctgctccagatgatggcgaaagaaggaggtgcctgctcccccaacgtggtggcatatagcacggtcatccatggcttcttaggaaggcgaaacaggcaaggcatgcaatctgttcca

SEQ ID NO: 2890 - DNA, 729 bp, Triticum aestivum; identical to SEQ ID NO: 2889

SEQ ID NO: 2891 - DNA, 729 bp, Triticum aestivum; identical to SEQ ID NO: 2886

SEQ ID NO: 2892 - DNA, 399 bp, Triticum aestivum
atggactgctgctgccgcgcgcgtcgcccggacctagggcttgccttattcggccgcttcctcaggacaggcctgaggacaaacgagatcgtcgccaccaccttcctcaagtgcctctgctgcgcaaaacagatagatgaggctgtgaaagtactgcttcacaggatgcccaagctgggctgtgtgcctaatgccatctcatactccatagttttgaaaagcttgtgtgaaaatagcatgagtcagcaggcactcgacctgctccagatggtagggaaagaaggaggctgccttcgtgatgtgatggcatataacacaatcatccatggcttctttaaggagggcggaatagacaaggcaaggggttatgccgactgtggtgacatacaacacagtaat

SEQ ID NO: 2893 - DNA, 684 bp, Triticum aestivum
atgcctcgcctctgctccaccacgcccatggcccgcctccgccgccggcgccgctactcctcctccacctcgtcgccttcacgccgttgggacccccgagccgcctttgccgcggccacggagcgcatccgcgccgggacgctcaggcctgaagacgcacaccacctgttcgacgaattgctactgcaggccaaccccgtccccgagcgctccctcagcgacttccttgccgcgctcgcccgtgctccgtcctccgctgctctcagagatggaccctcccttgctctcggcctcttcaacctcgtctgccgagaagaagcagggccgcaggtggcgccacccacaacctgcacctacaacatactcatggacagctgctgccgtgcacgccgcccggacctaggccttgccttcttcggccgcttcctgagtacgggcctcaaggcaaaccagatcgtcgccaccaccctcctcaagtgcctctgccacgcaagacggacagatgaggcaatcaacgtgctgctccataggatgtctgaattcggatgtgtgcctaatgtcatctcatactctatagtacttaagagcttatgtgatgatagcaggagccagcaagcgctcgacttgctccagatggtgaggaaaggaggtgcggctccctcagtgtggtggcatatagcacag

SEQ ID NO: 2894 - DNA, 684 bp, Triticum aestivum; identical to SEQ ID NO: 2893

SEQ ID NO: 2895 - DNA, 684 bp, Triticum aestivum; identical to SEQ ID NO: 2893

SEQ ID NO: 2896 - DNA, 684 bp, Triticum aestivum; identical to SEQ ID NO: 2893

SEQ ID NO: 2897 - DNA, 684 bp, Triticum aestivum; identical to SEQ ID NO: 2893

SEQ ID NO: 2898 - DNA, 684 bp, Triticum aestivum; identical to SEQ ID NO: 2893

SEQ ID NO: 2899 - DNA, 738 bp, Triticum aestivum
atgattgataaaggtgttaagccagacaatttgacatacactataatcattgatggcctatgcaaagctcaatcggttgatagggctgagggtgtctttcagcagatgattgataaaggtgttaagccaaacaatgggacatataattgtctcatccatggatacctatcaacaggacagtgggaagaggtggttcaaaggatcaaagaaatgtctgcacatgatcttgagccagatgtttttacttatggtttgcttctrgactatctatgcragaatggaaaktgcartgaagctagaagtttwtttgattctatgattaggaagggcataaaacctrrtgtwactatctaykscattatgcttcatggatatggtaccaaaggagctctttctgaaatgcatgatctcctgaatttgatggtagcaaatggtatttcccctaatcatcgcatcttcaacaccatgatctatgcatatgmtaaagaggcaatgatagatgaggcgatgcatatatttatcaaaatgaaacagcaaggtttaagtccagatgccgtcagttatgcagaattaatagatgcactttgcaagttgggcagagtggatgatgccgttctccaattcaagcagatgatcaatgaaggagtgactcctgacaatgtagtttttaactcccttgtttatggactttgcactgttgacaaatgggagaaggttgagaattatttttcgaaatgc

SEQ ID NO: 2900 - DNA, 759 bp, Triticum aestivum
atgagccgccgctttgtccccgtcgacagacgcatcttggagcggaacatcaaggctcggtaccacgctggagacattggcaccgaggatgcactcaacctgttcgacgaattgatccaggttgctgggccttcctcagtcctcgccatcaactgcctcctcaccgttgtcggccgtgattgccccgcgctcggcgtctccctcttcaaccgtgttgcaagagccaaggtgcctccccacaatatcacctatggcattctagtcgactgctgctgccgtgctggccgcttggaccttggacatgctggcatggggcacgtcattaagttgggatttgcagcagaagccatcgtcaatttcagccacctactcaaggccatctgcgccgaggagaagaccagctatgcaatggaaatcgtactccggataatgcctgaatttaactgcatcccgaacattttctcatacagcattcttttgaagggtctttgcaacgagaagaggagccaagaggctctcgagctgattcacatgatgattgaccatggaggtagctgccaacctaatgtggtgtcctatagcaccgtacttgatggcttgttgaaagatggtgaggtgggcaaggcctacagcctattttgtgtcatgctacagaggggaatttcgccgaatgttgtgacctgcaattcaatcatctctggcatgtgcaaagttcatgcgatggacaaggcagaggaggttcttcaacagatgactgat

SEQ ID NO: 2901 - DNA, 759 bp, Triticum aestivum; identical to SEQ ID NO: 2900

SEQ ID NO: 2902 - DNA, 759 bp, Triticum aestivum; identical to SEQ ID NO: 2900

SEQ ID NO: 2903 - DNA, 615 bp, Triticum aestivum
atgagccgccgctttgtccccgtcgacagacgcatcttggagcggaacatcaaggctcggtaccacgctggagacattggcaccgaggatgcactcaacctgttcgacgaattgatccaggttgctgggccttcctcagtcctcgccatcaactgcctcctcaccgttgtcggccgtgattgccccgcgctcggcgtctccctcttcaaccgtgttgcaagagccaaggtgcctccccacaatatcacctatggcattctagtcgactgctgctgccgtgctggccgcttggaccttggacatgctggcatggggcacgtcattaagttgggatttgcagcagaagccatcgtcaatttcagccacctactcaaggccatatgtgcggagaagaagaccagctatgcaatggacattgtactccggataatgcctgaatttaactgcatcccgaacattttctcatacagcattcttttgaagggtctttgcaacgagaagaggagccaagaggctctcgagctgattcacatgatgattgaccatggaggtagctgccaacctaatgtggtgtcctatagcaccgtacttgatggcttgttgaaagagggtgag

SEQ ID NO: 2904 - DNA, 615 bp, Triticum aestivum
atgagccgccgctttgtccccgtcgacagacgcatcttggagcggaacatcaaggctcggtaccacgctggagacattggcaccgaggatgcactcaacctgttcgacgaattgatccaggttgctgggccttcctcagtcctcgccatcaactgcctcctcaccgttgtcggccgtgattgccccgcgctcggcgtctccctcttcaaccgtgttgcaagagccaaggtgcctccccacaatatcacctatggcattctagtcgactgctgctgctgtgctggccgcttggaccttggacatgctggcatggggcacgtcattaagttgggatttgcagcagaagccatcgtcaatttcagccacctactcaaggccatatgtgcggagaagaagaccagctatgcaatggacattgtactccggataatgcctgaatttaactgcatcccgaacattttctcatacagcattcttttgaagggtctttgcaacgagaagaggagccaagaggctctcgagctgattcacatgatgattgaccatggaggtagctgccaacctaatgtggtgtcctatagcaccgtacttgatggcttgttgaaagagggtgag

SEQ ID NO: 2905 - DNA, 723 bp, Triticum aestivum
atgtcaagcctccgcctcctccgccgcagttccacctccacctccacctcgccgccctcgcgctcctggtctcccaccgcagcctttgccgcggccacagagcgtgtccgcgccgggacgcttagccaagatgacgcacaccacctgttcgacgaattgctgcggcaggccaccccggtccccgagcgccccctcaacggcttcctcgccgccctcgcacgtgctacgtcctctgccgcctgcatcacagatggccctgccctcgccgttgccctcttcaaccgcgtgtgtcgagagcaatccggcccgcgggtggtgcctctcacagtttgcacctacaacatcctcatggactgctgctgccgcacgtctcgcacggacctaggtcttgccttcttcgctcgactcctcaggacaggcctgaagacagatgagatcaccgccaacaccttcctcaagtgcctctgctacgcaaaacggacggatgaggctgtgaacgtgctgcttcataggatgtccgagctcggctgtgtgcctaatgccttctcatactccattgttctgaagagcttatgcaacaataacatgagtcagcgggcgctcgacctgctccagatgatggcgaaagatagaggtagctgtttccctgatgtggtggcatatagcagtcatccatggctttttcaaggaaggcgaaacaagcaaggcatgcaatctgttcca

SEQ ID NO: 2906 - DNA, 792 bp, Triticum aestivum
atgtcacgccttcaggtccgctctttctccagctccgtttcctcacgcgccaacgagctgctgaacgaactccacgaccatcttggcttcgggacactcaggccagagctcgcgcaccaactgttcgacgaaatgctgcaccaacctgtcacagtatcagtacgtgcactcgacgacttatttgctgccctcgcgcgtgtgccggcctcacctgcctgcaccgatggccctgccctcgccattgatctcttcaaccgcatggcccgagcaggccgtcgccaggtgctagcaccctccatttacacctacaacatactaattgagtgttgccaccgagcatgccgcccagacctagggcctgccttcttcggccgcctcctcaagacaggcatcaagacggatgtcgttacctacagcagcttactcaagtgcctctgtgacatgaagcgaacagaggaggctttgggcgtgctgctccacaggatgcccgacgacctgcctaatgtcatctcctactcagtaattctcaagagtttctgcgacagtggtaggagccagcttgcacttgacttgctccggatgatggccgaaaaaggatctgaccactctcccagcatggtgttatacagcttggtaatcgatggcttcttgaaggagggtgaaataagcaaagcatgcaatttgctccctgaaatgatgcagcagggggttgtgcctgatgtggtgacgtataactcctttatcgatgcgctatgcaaagcaagagcaatggacaaggcagaggtagttctt

SEQ ID NO: 2907 - DNA, 792 bp, Triticum aestivum
atgtcacgccttcaggtccgctctttctccagctccgtttcctcacgcgccaacgagctgctgaacgaactccacggccatcttggcttcgggacactcaggccagagctcgcgcaccaactgttcgacgaaatgctgcaccaacctatcacagtatcagtacgtgcactcgacgacttatttgctgccctcgcgcgtgcgccggcctcacctgcctgcaccgatggccctgccctcgccattgatctcttcaaccgcatggcccgagcaggccgtcgccaggtgctagcaccctccatttacacctacaacatactaattgagtgttgccaccgagcatgccgcccagacctagggcctgccttcttcggccgcctcctcaagacaggcatcaagacggatgtcgttacctacatcagcttactcaagtgcctctgtgacatgaagcgaacggaggaggctttgggcgtgctgctccacaggatgcccgacgacctgcctaatgtcatctcctactcagtaattctcaagagtttctgcgacagtggtaggagccagcttgcacttgacttgctccggatgatggccgaaaaaggatctgaccactctcccagcgtggtgttatacagcttggtaatcgatggcttcttgaaggagggtgaaataagcaaagcatgcaatttgctccctgaaatgatgcagcagggggttgtgcccgatgtggtgacgtataactcctttatcgatacgctatgcaaagcaagagaaatggacaaggcagaggtagttctt

SEQ ID NO: 2908 - DNA, 792 bp, Triticum aestivum
atgtcacgccttcaggtccgctctttctccagctccgtttcctcacgcgccaacgagctgctgaacaaactccacgaccatcttggcttcgggacactcaggccagagctcgcgcaccaactgttcgacgaaatgctgcaccaacctgtcacagtatcagtacgtgcactcgacgacttatttgctgccctcgcgcgtgtgccggcctcacctgcctgcaccgatggccctgccctcgccattgatctcttcaaccgcatggcccgagcaggccgtcgccaggtgctagcaccctccatttacacctacaacatactaattgagtgttgccaccgagcatgccgcccagacctagggcctgccttcttcggccgcctcctcaagacaggcatcaagacggatgtcgttacctacagcagcttactcaagtgcctctgtgacatgaagcgaacagaggaggctttgggcgtgctgctccacaggatgcccgacgacctgcctaatgtcatctcctactcagtaattctcaagagtttctgcgacagtggtaggagccagcttgcacttgacttgctccggatgatggccgaaaaaggatctgaccactctcccagcatggtgttatacagcttggtaatcgatggcttcttgaaggagggtgaaataagcaaagcatgcaatttgctccctgaaatgatgcagcagggggttgtgcctgatgtggtgacgtataactcctttatcgatgcgctatgcaaagcaagagcaatggacaaggcagaggtagttctt

SEQ ID NO: 2909 - DNA, 792 bp, Triticum aestivum
atgtcacgccttcaggtctgctctttctccagctccgtttcctcacgcgccaacgagctgctgaacgaactccacgaccatcttggcttcgggacactcaggccagagctcgcgcaccaactgttcgacgaaatgctgcaccaacctgtcacagtatcagtatgtgcactcgatgacttatttgctgccctcgcgcgtgtgccggcctcacctgcctgcaccgatggccatgccctcgccattgatctcttcaaccgcatggcccgagcaggccgtcgccaggtgctagcaccctccatttacacctacaacatactaattgagtgttgccaccgagcatgccgcccagacctagggcctgccttcttcggccgcctcctcaagacaggcatcaagacggatgtcgttacctacagcagcttactcaagtgcctctgtgacatgaagcgaacggaggaggctttgggcgtgctgctccacaggatgcccgacgacctgcctaatgtcatctcctactcagtaattctcaagagtttctgcgacagtggtaggagccagcttgcacttgacttgctccggatgatggccgaaaaaggatctgaccactctcccagcgtggtgttatacagcttggtaatcgatggcttcttgaaggagggtgaaataagcaaagcatgcaatttgctccctgaaatgatgcagcagggggttgtgcccgatgtggtgacgtataactcctttatcgatgcgctatgcaaagcaagagcaatggacaaggcagaggtagttctt

SEQ ID NO: 2910 - DNA, 792 bp, Triticum aestivum; identical to SEQ ID NO: 2908

SEQ ID NO: 2911 - DNA, 792 bp, Triticum aestivum; identical to SEQ ID NO: 2906

SEQ ID NO: 2912 - DNA, 792 bp, Triticum aestivum; identical to SEQ ID NO: 2908

SEQ ID NO: 2913 - DNA, 531 bp, Triticum aestivum
atggcgcagcagggcgttaagcctaatgtggtgacatataactcagttatcgatgcgctgtgcaaggccaaagccatggacaaggcagaggtggtccttcgtcaaatgattgatcatagtgttggacctaatagcgtgacgtatagtagcctcatccatggatattcctcttcaggccactggaaggaggcagttagggtattcaaagagatgacaagtcggagggttacagcagatgtgcatacttacaacatgtttatgacctttctttgcaagaatggaaaaagcaaagacgctgcagaaatttttaattcaatggccacgaagggcctaaaacctacgaccgtttcatatgctattctccttcatgggtatgccaccgaaggatgcttagttgatatgactaatttcttcaattcaatggaaagagactgtattctaccagactgttgtatcttcagcatactgattaatgcatatgctaaatctgggaagcttgataaggcaatgcttttacacacggcgatttgg

SEQ ID NO: 2914 - DNA, 645 bp, Triticum aestivum
atgtcccacgtccgcctccacctccaccgccggctcctctcatccacctcgccgccctcacgttcctggtctccccgcgacgcctttgccgtgaccacagagcggctgcgcgccgggacgctctgtcgagacgatgcacacaacctgttcgacgaattgtttcggcaggcaatcccggtccccgaccgctccctgaacggcttccttgccgccctcgcccgtgctacgtcctctggcgcctgcatcagagatggccccgccctcttcaaccgcgtgtgccgagaacaagccggctcgcaggtggcgcctctcacagtccacacctacaacatcctcatggactgctgctgccgtgcgtgtcgcccagatctagggcttgccttgttcgggtgtatcctcaggacgggcttgaagatagaacaaatcaccgccaacaccctcctcaagtgcctctgctatgcgaaacggacagaagaggctgtgtacgtgctgcttcataggatgtctgagctcggatgtgtgcctgatgccttctcatgctccattgttctgaagagcttatgcgacaacagcatgagtcagcggggccttgacctgctccagatgatggcgaaaggaggtggctgctccctcaatgtgggcata

SEQ ID NO: 2915 - DNA, 645 bp, Triticum aestivum
atgtcccacgtccgcctccacctccaccgccggctcctctcatccacctcgccgccctcacgttcctggtctccccgcgacgcctttgccgcgaccacagagcggctgcgcgccgggacgctctgtcgagacgatgcacacaacctgttcgacgaattgtttcggcaggcaatcccggtccccgaccgctccctgaacggcttccttgccgccctcgcccgtgctacgtcctctggcgcctgcatcagagatggccccgccctcttcaaccgcgtgtgccgagaacaagccggctcgcaggtggcgcctctcacagtccacacctacaacatcctcatggactgctgctgccgtgcgcgtcgcccagatctagggcttgccttgttcgggtgtatcctcaggacgggcttgaagatagaacaaatcaccgccaacaccctcctcaagtgcctctgctatgcgaaacggacagaagaggctgtgtacgtgctgcttcataggatgtctgagctcggatgtgtgcctgatgccttctcatgctccattgttctgaagagcttatgcgacaacagcatgagtcagcggggccttgacctgctccagatgatggcgaaaggaggtggctgctccctcaatgtgggcata

SEQ ID NO: 2916 - DNA, 645 bp, Triticum aestivum; identical to SEQ ID NO: 2915

SEQ ID NO: 2917 - DNA, 645 bp, Triticum aestivum; identical to SEQ ID NO: 2915

SEQ ID NO: 2918 - DNA, 645 bp, Triticum aestivum; identical to SEQ ID NO: 2915

SEQ ID NO: 2919 - DNA, 645 bp, Triticum aestivum
atgtcccacgtccgcctccacctccaccgccggctcctctcatccacctcgccgccctcacgttcctggtctccccgcgacgcctttgccgcgaccacagagcggctgcgcgccgggacgctctgtcgagacgatgcacacaacctgttcgacgaattgtttcggcaggcaatcccggtccccgaccgctccctgaacggcttccttgccgccctcgcccgtgctacgtcctctggcgcctgcatcagagatggccccgccctcttcaaccgcgtgtgccgagaacaagccggctcgcaggtggcgcctctcacagtccacacctacaacatcctcatggactgctgctgccgtgcgcgtcgcccagatctagggcttgccttgttcgggtgtatcctcaggacgggcttgaagatagaacaaatcaccgccaacaccctcctcaagtgcctctgctatgcgaaacggacagaagaggctgtgtacgtgctgcttcataggatgtctgagctcggatgtgtgcctgatgccttctcatgctccattgttctgaagagcttatgcgacaacggcatgagtcagcggggccttgacctgctccagatgatggcgaaaggaggtggctgctccctcaatgtgggcata

SEQ ID NO: 2920 - DNA, 747 bp, Triticum aestivum
atgccacgcgtgcgacccggctcgtcctccagcaccgtctcctcacgcgccaaccagctgctaaacaaactcaaggatcatctggactctgggacgctccagccggagcgcgcacaccaactgttcgacaaattgctgcgccaaaccgttccggtatcagcgtccgcactcaatggcttatttgccgccctcgcgcgtgcgctgccctccgctgcctgcaccgacggccctgctctagccattgctctcttcaaccgcatggctcgagagggccgccgggtgatagcacccaacatttacacctacagcatactaattgactgctgctgccgctcgcgccgccctgacctaggtcccgccttcttcgggttcctcctcaagacaggcatcaaggcggacatcatcaccttcaccagcctattcaagtgcctctgtcacatgaagcggatagacgaggctgtgggagtgctgcttcacaggatgcccggcgatatgcctgatgccatctcctactcaataattctcaagagcttctgcaatgaggggaggagccaacgtgcacttgacctgctccggatgatggccaaaaagggagctaatcactcccccgaagcatgcaccatagtaatctgtggcttaattaaggagggtgaactaagcaaagcatgctctctattccatgaaatgatgcagcagggggtcgtgcctagtgtggtagcatatagctccattatcgatgggttgtgc

SEQ ID NO: 2921 - DNA, 672 bp, Triticum aestivum
atggaaaaagctttgagagtacttgatgacatggcatccgctggcattgagcctaatgttgttacatatggtacacttgttgacggctactgtagaagtggaaggattgatgatgggttgatgctattcagagaaatgttgcataagagagttgaacctacaactgttacctataacatcatactgaatgggttatttcatgctgggagaacggttgctgcaaagatgttccatgagatgatcaaaagtggaataacagtgagcatttccacatacatgataatccatggaggactttgcaggaatagtcatgctgacgaagcgatcaccctgttccagaaattaggagcaatggatgtgaagttggatgttacaatactcaataccatgatcaatgcaatgttcaaggttcagagaagagaagaagctaacgatttgtttgctgcaatatctgccagtggattggtacctaatgcttctacttatggcaaaaatatacaaaatcttctagaagaaggatcattggaagaagctgacgatatgttttcatcaatggagaagagtggttgtgctcccagttcttgtcttttaaattttatcatcagaacgttattgaaaaagggggagatagtaaaggctggaaattatctctactcatataaaaagcacact

SEQ ID NO: 2922 - DNA, 672 bp, Triticum aestivum; identical to SEQ ID NO: 2921

SEQ ID NO: 2923 - DNA, 672 bp, Triticum aestivum; identical to SEQ ID NO: 2921

SEQ ID NO: 2924 - DNA, 672 bp, Triticum aestivum; identical to SEQ ID NO: 2921

SEQ ID NO: 2925 - DNA, 747 bp, Triticum aestivum
atgtcacgccgctataccatcacactgatctcccgcctccgagtcccccgccgctgctcctcctccacctccatctcgccgccctcacgctcctggtctccccgcgacgcctttgccgcggccacagagcgcgtgcgcgccggcacgctcagcccggaagatgcacacaacctgttcgatgaattgctgcggcagggcactccggtccccgagcgctccctgaacggcttccttgccgccctcgcccgtgctacgtcctccactgcctgcatcaaagatggccccgccctcgcccttgctctcttcaaccgtgtgtgcagagaagaagccagcccgcaggttgcagtgcccaccgtttgcacctacagcgtcctcatggactgctgctgccgcgcgcgtcgcccagacctagggcttgccttattcggctgcatcctcaggaagggcttgaagatagaccaaatcaccgccaacaccctcctcaagtgcctctgctatgcaaaacagacagaagaggctgtgtacgtgctgcttcataggatgtcggagctcagctgtgtgcctgatgccttcgcatacaacatagttcttaagagcttatgtaaaggtagcaggagccagcgggcgcacgacctgctccggacgatggcaaaagatagaggtggctgcttccctgatgtggtgacatataccacggtcatccatggctttttcaaggagggcgaaacaggcatgcaatctattcca

SEQ ID NO: 2926 - DNA, 666 bp, Triticum aestivum
atgttgtgcaagggacttaaaccaacaacttttaattacaacgtcatactggatggattatttctggctggacaaactgttgctgcaaaagagaagtttcatgagatggttgaatctggagtaactgtgtgcattgatacatactctatagttcttggtggactttgtagaaatagctgcagtagcgaagcgatcaccctgttccagaaattaagcgcaatgaatgtgaaatttgatattacaattgtcaatatcattattggtgccttctacagggtcgagagaaaccaagaggctaaggatttgtttgctgctattccagccaatggcttggttcctaatgttgttacctacaccataatgatgacaaatcttataaaagagggttcagtggaagaagctgacaatcttttcttatcgatggagaagagcggctgtactgccaactcttgcctgttaaatcatatcatcagaaggttactggaaaaaggagagatagtcaaggctggaaattatatgtctaaagttgatgcaaagagctactcacttgaagctaaaactgtttcacagctgatctctctgttttcaaggaaagggaaatatagagaacacatcaaattgctccctacaaagtatcagtttctggaagaagcagccacagttgaa

SEQ ID NO: 2927 - DNA, 534 bp, Triticum aestivum
atgccccatctccgcctccgccgcttctccaccgcgccgatgttccacctcctccactgcagctcctcctccacctccacctcgccgccctcgcgttcctggtctccccatgccgcctttgccgccgccacagagcgtgtccgtgccgggacgctcagcccagaagacgtgcaccacctgttcgacgaattgctacggcaggccaccccggtccccaggcgctccctcaatggcttcctttccaccctcgcccgtgcgcccgcctcggccgcctgcattagagccagccagcaggtggcacctttgacagtccacacctacggcatcctcatgggctgcttctgcggtgcgcgtcgcccggacctagggcttgccttattcggccgcttcctcaggacaggcctgaagacaaatgagatcatcgccaccaccttcctcaagtgcctctgctccgccaaacgtacagatgagtgtcggtgtcaaaaccggcggatctctggtagggggtcccgaactgtgcgtctaggcggatgg

SEQ ID NO: 2928 - DNA, 594 bp, Triticum aestivum
atgcactcaaatgaggcattggatctgctgctccaccggatgcccgaactggactgtgcgcctgatgtcttctcgttcaacatagtaatcaacggctgctttaragaagrtgaagtagacaaagcrtgcaatctcttccatgagatgccccaactgggagttcaacctgatgtggtgacctacacctcaatcatggacgcactaagcaagtccggagcaatggacaaggcagaagtgctccttcggcaaatggttgatcaaggaattgaacccaatatcaggacatatagctgtctgatccatggatattctacttttggtcagtggaaggaggcacttagggtattcaaagaaatggcaagtcttggtgttcgaccaaattctgtcacgttgaactcatttattgattccctttgcaagcatagaaagacaaagaaagctagagatatttttgactccatggccgcaaagggccacaaacctgatattttctcctactctactatgcttaattggtatgcgaaagaaggatgcttcgatgatatgactgatctcttcaattcgatggtacggaatggtatcgtacggaatgga

SEQ ID NO: 2929 - DNA, 459 bp, Triticum aestivum
atgcgccaacgagctgctgaacgaactccactccacggccatctgggcttcgggacactcaggccagatctcgcgcaccaactgttcgacgaaatgctgcgccaaccagtcccagtatcagtacgtgcactcaacggcttatttgctgcccttgcgcgtgcgccgccctccaccatctgcaccgatgcccctgccctcgccattgatctcttcaaccgcatggcccaagcaggccgtcgccaggtgccagcacccaccattatcacctacaacatactgattggctgctgccatcgagcatgccgcccggacctagggcctgccttcttcggtcgcctcctcaagacaggcatcaagacgaatgtcattacctacaacagcttactcaagtgcctctgtgacatgaagcgcacggaggaggctttgggcgctgctccacaggatgcccgacgacctgcc

SEQ ID NO: 2930 - DNA, 459 bp, Triticum aestivum; identical to SEQ ID NO: 2929

SEQ ID NO: 2931 - DNA, 459 bp, Triticum aestivum; identical to SEQ ID NO: 2929

SEQ ID NO: 2932 - DNA, 459 bp, Triticum aestivum; identical to SEQ ID NO: 2929

SEQ ID NO: 2933 - DNA, 732 bp, Triticum aestivum
atgccccgccgcatcccgctgccgatgccccgccgcatatgcatctggctccgctgctcctccccatcctcatcctgcacctatcccgactccggtctccgccacccgtcctgccttacctctacgttgtccggcctccgcctccgccgctccttcaccactccgatgtcgaacctccgcctcttccgccgcagctcctcctccacctccacccccacctcgcggtcctcacgttcatggtctccccacgcagcctttgccgcggccacagagcgtgtccgcgccgggacgatgaaccaagactacgcacacaacctgttcgacgaattgctgcggcaggccaccccggtccccgggcgctccctgaatggcttcctcgccgccctcgcacgtgctacgtcctctgccgcctgcatcagaaatggtcccgccctcaccgtcgccctcttcaaccgcgtgtgccgagaacaagccggcctgcgggtggcgcctctcacagtccacacgtacaacatcctcatggactgctgctgccgcgcatctcgcccggacctaggtcttgccttattcggccgctttctcaggacgggcctcaagacaaacgagatcgtcgccagcaccctcctcaagtgcctctgctacacaaaacggacggatgaggctctgaacgtgctgcttcataggatgtccgagctcggctgttgcctaatgccatctcatacaacattgttc

SEQ ID NO: 2934 - DNA, 732 bp, Triticum aestivum; identical to SEQ ID NO: 2933

SEQ ID NO: 2935 - DNA, 732 bp, Triticum aestivum
atgccccgccgcatcccgctgccgatgccccgccgcatatgcatctggctccgctgctcctccccatcctcatcctgcacctatcccgactccggtctccgccacccgtcctgccttacctctacgttgtccggcctccgcctccgccgctccttcaccactccgatgtcgaacctccgcctcttccgccgcagctcctcctccacctccacccccacctcgcggtcctcacgttcatggtctccccacgcagcctttgccgcggccacagagcgtgtccgcgccgggacgatgaaccaagactacgcacacaacctgttcgacgaattgctgcggcaggccaccccggtccccgggcgctccctgaatggcttcctcgccgccctcgcacgtgctacgtcctctgccgcctgcatcagaaatggtcccgccctcaccgtcgccctcttcaaccgcgtgtgccgagaacaagccggcctgcgggtggcgcctctcacagtccacacgtacaacatcctcatggactgctgctgccgcgcatctcgcccggacctaggtcttgccttattcggccgctttctcaggacgggcctcaagacaaacgagatcgtcgccagcaccctcctcaagtgcctctgctacgcaaaacggacggatgaggctctgaacgtgctgcttcataggatgtccgagctcggctgttgcctaatgccatctcatacaacattgttc

SEQ ID NO: 2936 - DNA, 732 bp, Triticum aestivum; identical to SEQ ID NO: 2933

SEQ ID NO: 2937 - DNA, 732 bp, Triticum aestivum; identical to SEQ ID NO: 2933

SEQ ID NO: 2938 - DNA, 732 bp, Triticum aestivum; identical to SEQ ID NO: 2933

SEQ ID NO: 2939 - DNA, 756 bp, Triticum aestivum
atgagggtgacatatagctccataatcaatgcgctatgcaaagcaagagcaatggataaggcagaggtgatccttcgacatatggttcataatggtgtccaaccacatgataggatatataataccctaatccatggatttttaactttgggtcagctgaaagaagcctttaggttgttgaaagtaatgagaagccaaggtagtatgccaaacggtgttacttgcacctcagtcatggactacctttgcaagcatggaagaatcaaagaagctgaggaaatattttattccatggccgtgaatggccgaaaaccagatatagtctcatactctattatgctccatgggtacgctatagaaggatcccttgttcaaatgattgatctctgtgagctgatggcaagagacggagttgtacccaacctccggtgtttcaacatactgattaatgcatatgctaagtatggcaggatggatgtggccatgcttttctttgaagacatgttgaagcagggtgtgaagcctaatgaattcacttatttaaccgtgatatctgcattttgcaagatgggcaggatggatgatgcgatggaaaagttcagtgagatgattgatatgggagtaccacttgagacagaagtttacatgtgcatggttgagggttattttaatcatggtgattccatgaaagccgaggaatttattaccaagatgaagaacagggatattcatcataagccatggaaaggtaatcga

SEQ ID NO: 2940 - DNA, 729 bp, Triticum aestivum
atgatgcagcaaggtgtcgagcccagtgtgtggacatatagttcaatcattgatgcattgtgcaaggcaagagcaatggacaaggcagagctagtgcttcagcagatggttaacaaaggtgttcaacccaataatgtcacatataattgcatgatccatggatattccacatctgggaggtggaaagaggctgctaaattgtttagagaaatgaaaagccggggccttataccagatacttttacttgcaacgccttaatgacttacctttgtaagcatggaagaagcaaagaagctgcagaaatttctgatgccatgactgccaaaggccacaagccggatatcgtctcatacagtattttgcttcatgggtatgccaatgaaggatgctttgctgatatgattgatctctttaattcaatggaaaggaacggcattgcagccgactgccatgttttcagcatattaatcggtgcgtatgctaaatgtgaattaatggatgaagctatgctcaaatttactcaaatgcggcgacaaggagtgagtcctgatgcgttcacatattcaactgtaatagtcgcactttgtagagtgggtaggctggctgatgcaattggcaaatttggtgagatgattgctatgggagtacagccggacagacctgtttatcgctccctaattcagggttgttttatgcatggtggcttggttaaagccacagctggtttc

SEQ ID NO: 2941 - DNA, 729 bp, Triticum aestivum; identical to SEQ ID NO: 2940

SEQ ID NO: 2942 - DNA, 729 bp, Triticum aestivum; identical to SEQ ID NO: 2940

SEQ ID NO: 2943 - DNA, 729 bp, Triticum aestivum; identical to SEQ ID NO: 2940

SEQ ID NO: 2944 - DNA, 729 bp, Triticum aestivum; identical to SEQ ID NO: 2940

SEQ ID NO: 2945 - DNA, 729 bp, Triticum aestivum; identical to SEQ ID NO: 2940

SEQ ID NO: 2946 - DNA, 675 bp, Triticum aestivum
atggttcataatggtgtccaaccagatgttgtgacatataatagcttgatccaaagatttttaacttcggggcagctgaaagaagccattaggttgttgaaactgatgacaagccaaggtattatgccagacgttgttacctgcaactcagtcatgacctaccattgcaagaatggaagagtcaaagaagctgccgaaatattttattccatggctgtgaagggccgaaaacctaatgtcatctcatactctattatgctccatgggtacgctatacaaggaccccttgttgaaatgattgacctctgtgagctgatggcaagagatggagttgtacccaacctccattgtttcaacatactgattaatgcatatgctaagtatggtaggatggatgtggccatgcttttctttgaagacatgttgaagcagggtgtgaagcctaatgaattcacttatttaactatgatgtctgcattttgcaagatgggcaggatggatgatgtgatggaaaaattaagtgagatgattgatatgggagtaccagttgacacagaagtttgcatgtgcatggttgagggttattttaatcatggtgattccatgaaagccaaggaatttattaccagaatgaagaacatggatattcatcataagccacggaaaggtaatcga

SEQ ID NO: 2947 - DNA, 675 bp, Triticum aestivum; identical to SEQ ID NO: 2946

SEQ ID NO: 2948 - DNA, 675 bp, Triticum aestivum; identical to SEQ ID NO: 2946

SEQ ID NO: 2949 - DNA, 675 bp, Triticum aestivum; identical to SEQ ID NO: 2946

SEQ ID NO: 2950 - DNA, 675 bp, Triticum aestivum; identical to SEQ ID NO: 2946

SEQ ID NO: 2951 - DNA, 651 bp, Triticum aestivum
atggaaaaagctttgagagtacttgatgacatggcatccgctggcattgagcctaatgttgttacatatggtacacttgttgacggctactgtagaagtggaaggattgatgatgggttgatgctattcagagaaatgttgcataagagagttgaacctacaactgttacctataacatcatactgaatgggttatttcatgctgggagaacggttgctgcaaagatgttccatgagatgatcaaaagtggaataacagtgagcatttccacatacaggataatccatggaggattttgcaggaatagtcatgctgacgaagcgatcaccctgttccagaaattaggagcaatggatgtgaagttggatgttacaatactcaataccatgatcaatgcaatgttcaaggttcagagaagagaagaagctaacgatttgtttgctgcaatatctgccagtggattggtacctaatgcttctacttatggcaaaaatatacaaaatcttctagaaggaggatcattggaagaagctgacgatatgttttcatcaatggagaagagtggttgtgctcccagttcttgtcttttaaatcagaacgttattggaaaagggggagatagtcaaggctggaaattatctctactcata

SEQ ID NO: 2952 - DNA, 651 bp, Triticum aestivum; identical to SEQ ID NO: 2951

SEQ ID NO: 2953 - DNA, 729 bp, Triticum aestivum
atgagccgccgcctcgtccccgtcggcagccgcctcttggagcggaacatcgagcaccgataccgctccagaaacattggtaccgaggacgcactcaacctgttcggcgaattgatccaggatcctgggcctacctcggtccgcgccatcaacggcctcctcaccgtcgtcggccgtgattgccccgcactcggcatctccctgttcaaccgtgttgcaagagccaaggtgcctccccacaatatcacctatggcattctagttgactgctgctgccgtgctggccgcttggaccttggacacgctgccatgggacacgtcattaagttgggatttgcagcagaagccatcgtcaatttcagccacctactcaaggccatctgtgcggagaagaagaccagctatgcaatggacatcgtactccgaataatgcccatgtttaactgcataccgaacattttctcctacagcattcttttcaagggtctctgcaacgagaagagaagccaagaggctctcgagctgattcacttgatggttgaggatggaggtagctgccaacctaatgtcgtgtcctataccaccgtagttgatggtttgttgaaagagggtgaggtaggcaaggcttacagcctattttgtgaaatgctacagaggggaatttcgccggatgatgtgacatataactcaatcatctctggcatgtgcaaggttcatgcgatggaaggc

SEQ ID NO: 2954 - DNA, 738 bp, Triticum aestivum
atggagaaaggaggtgtctgctcccctgatgtggtgtcatataccacggtcatccacggcctccttaaggaaggggaagtaagcaaggcatgcagtctgtttgatgaaatggtgcagcaaggggttgtgcctaatgtggtgacatacagctcgattattgatgcgctgtgcaaggctggagcgatggacaagacagagttggtcctttggcagatggttgatagtggcatccaaccggataacgtgacatatactagcatgatccacggatattccacgttgggccggtggaaagaagcaggcaaaatgttcagagaaatgacaagccggggtatcataccagatgttgttacttggacctcattcatgacctccctctgcaagcatggaagaagcagagaagctacaggaattattgattacatgtctgccaagtgccacaagcctaatatcgtcttgtactctattctgtttcatggatatgctacagaaggatgctttgatgatatgattaatctccttgactcgatggcaaacaacgctattgttcccaatcgccaggttttcagcattttagttgatgcatatgctaaacgtggaatgatggacgaagctatgcccatatttactggaatgtgtgaacaaggagtgatccgagatgtttacagatggggacaaggagtgagtccagagtctacagtaggtaggctggcggatgctttgaacaagttcgtcaga

SEQ ID NO: 2955 - DNA, 738 bp, Triticum aestivum; identical to SEQ ID NO: 2954

SEQ ID NO: 2956 - DNA, 738 bp, Triticum aestivum; identical to SEQ ID NO: 2954

SEQ ID NO: 2957 - DNA, 738 bp, Triticum aestivum; identical to SEQ ID NO: 2954

SEQ ID NO: 2958 - DNA, 738 bp, Triticum aestivum
atggagaaaggaggtgtctgctcccctgatgtggtgtcatataccacggtcatccacggcctccttaaggaaggggaagtaagcaaggcatgcagtctgtttgatgaaatggtgcagcaaggggttgtgcctaatgtggtgacatacagctcgattattgatgcgctgtgcaaggctggagcgatggacaagacagagttggtcctttggcagatggttgatagtggcatccaaccggataacgtgacatatactagcatgatccacggatattccacgttgggccggtggaaagaagcaggcaaaatgttcagagaaatgacaagccggggtatcataccagatgttgttacttggacctcattcatgacctccctctgcaagcatggaagaagcagagaagctacaggaattattgattacatgtctgccaagtgccacaagcctaatatcgtcttgtactctattctgtttcatggatatgctacagaaggatgctttgatgatatgattaatctccttgattcgatggcaaacaacgctattgttcccaatcgccaggttttcagcattttagttgatgcatatgctaaacgtggaatgatggacgaagctatgcccatatttactggaatgtgtgaacaaggagtgatcccagatgtttacagatggggacaaggagtgagtccagagtctacagtcggtaggctggcggatgctttgaacaagttcgtcaga

SEQ ID NO: 2959 - DNA, 738 bp, Triticum aestivum; identical to SEQ ID NO: 2958

SEQ ID NO: 2960 - DNA, 675 bp, Triticum aestivum
atgagccgccgccttgtccccgtcggcagacgcatcttggagcagagcatcaaggatcggtactactcggcaggcattggcaccgaggatgcactccagctgtttgacgaattgctcccggatgctgagccatccttgatccgtgccatcaactgcctcctcactgtcatcggccgtgattgccccgcgctcggcgtctcccacttcaaccgcgttgcaagggccaatgtggcacccaacagtatcacgtacaccatcctcgtcgactgctgctgccgtgctggccgcttggacctcggtttcgccgccatgggccacattattaagatgggatttacagcagaagctatcttcactttcaaccacctactcaaggccatctgtgcggagaagaagaccagctatgcaatggacatcgtactccgaataatgcctgagcttaactgcacaccgaatgttttctcctacaacattcttttcaagggtctctgcaacgagaagagaagccaagaggctctcgagctgattaacattatggttgaggatggaggtagctgccgacctgatgtggtgacctataacaccgtaattggtggcctgttgaaagagggtgtggtggacaaggcttacagcctattttgtgaaatgctaaaaggcagattttgccaaatgctg

SEQ ID NO: 2961 - DNA, 675 bp, Triticum aestivum; identical to SEQ ID NO: 2960

SEQ ID NO: 2962 - DNA, 675 bp, Triticum aestivum; identical to SEQ ID NO: 2960

SEQ ID NO: 2963 - DNA, 675 bp, Triticum aestivum; identical to SEQ ID NO: 2960

SEQ ID NO: 2964 - DNA, 675 bp, Triticum aestivum; identical to SEQ ID NO: 2960

SEQ ID NO: 2965 - DNA, 675 bp, Triticum aestivum; identical to SEQ ID NO: 2960

SEQ ID NO: 2966 - DNA, 666 bp, Triticum aestivum
atgacaaatcggagtgttacaccagatgtgtgtacttacaacttgttgatgacctccctttacaagaatggaaatagcaaagaagctgcacaattgttttattcaatggccacgaagggcctgaaacctgacaccgtttcatatgctattctccttcatgggtatgccactgaaggatgcttggttgacatgatcaatctcttcaattcaatggcaacagactgtattctacctaactgtcatatcttcaacatactgatttatgcatatgctaaatctgggaagcttgataaggctatgcttatatttaaagatatgcagaaacaaggagtgagtccagatgcagtcacatattcaaccgtaatacatgcattttgcaaaaagggtaggttggatgatgctgtgataaagtttaatcagatgattgatacaggagtacgaccggaagcatctgcttatcgttccctaatccagggtttttgtacacatggcgatttggtgaaagcaaaggaatatgttactgaaatgatgaagaaaggtatgcttcctcctgatattatgttcttcagttcaatcatgcagaaactatgcacagaaggaagggaaattatatatcgaaagttgatgcaaagagctactcacttgaagctaaaactgtttcgctgc

SEQ ID NO: 2967 - DNA, 717 bp, Triticum aestivum
atggttcatagcggtgttcgaccggatactgtgacatatactagcctgatccatggatattctactttgggccagtttgaagaggttgttaggttgttggaagaaatgagaagtctaggtgtcaaaccaaatgtttttacttgtaacacagtcatggactacctttggaagcatggaagaatcaaagaagctgcagaatttttttattccatggctgagaagggccataaacctaatatagtctcgtatgctattatgcttcatgggtacgctaaagaaggatcccttgttgaaatgagtgatctctgtgagctgatggcaagagatggtattgtacccgatctccgttgtttcaacatactgattaatgcatatgctaagtgtggaatgatggatgtggctattcttttcttcaaagacatgttgaagcagggagtgaaccctgatgaaatcacatatttagctgtgatagccgggtattgcagagtgggcatgatggatgatgctatggaaaatttcaatgagatgatcggtatgggagtaccacataacgcaactgtttacaggtgcatgattcagggttacttaaatcatggtgatttcttgaaagcaaaggaattgattactgaaatgaagaccaagggtatccatcctagaccgcggaaaagccaaggaattgatccagggtacctcatgacgcaactgtttacaggtgca

SEQ ID NO: 2968 - DNA, 651 bp, Triticum aestivum
atgtcccgcatccacctccaccgtcgcctcttctcctccaccacgcggcccttgcgttcctggtctccccgcgccgcctttgccgcggtaacagagcgcgtccgcgctggggcgctcagccaagacgatgcacaccacctgttcgacgaattgctgcggcaggccaccccggtccccgggcgctccctcgacggcttccttgccgccctcgtccgtgcgcccgcctccggagcctgcagagatgggcccgccctcgccctcgctctcttcaaccgcgtctgccgggatgaatccggcgcgcgggtggcaccgcccacaatcttcacctacggcatcctcatgaactgctgctgccgcgcgcatcgcccggacctagggctcgccttcttcgctcgcctcctcacgacgggcctgaaggctgaccagatcgccgccaacaccttccttaagtgcctctgttacgcaaaacggacggatgaagctgtgaacgtgctgcttcataggatgtccgagctcggctgtgtgcctaatgccttctcatactccattgttctgaagagcttatgcgacaatagcatgagtcagcgggcgctcgacctgctccagatgatgaccagatggagaaatgacaagtcagggtcttataccaga

SEQ ID NO: 2969 - DNA, 651 bp, Triticum aestivum
atgtcccgcatccacctccaccgtcgcctcttctcctccaccacgcggcccttgcgttcctggtctccccgcgccgcctttgccgcggtaacagagcgcgtccgcgctggggcgctcagccaagacgatgcacaccacctgttcgacgaattgctgcggcaggccaccccggtccccgggcgctccctcaacggcttccttgccgccctcgtccgtgcgcccgcctccggagcctgcagagatgggcccgccctcgccctcgctctcttcaaccgcgtctgccgggatgaatccggcgcgcgggtggcaccgcccacaatcttcacctacggcatcctcatgaactgctgctgccgcgcgcatcgcccggacctagggctcgccttcttcgctcgcctcctcacgacgggcctgaaggctgaccagatcgccgccaacaccttccttaagtgcctctgttacgcaaaacggacggatgaagctgtgaacgtgctgcttcataggatgtccgagctcggctgtgtgcctaatgccttctcatactccattgttctgaagagcttatgcgacaatagcatgagtcagcgggcgctcgacctgctccagatgatgaccagatggagaaatgacaagtcagggtcttataccaga

SEQ ID NO: 2970 - DNA, 651 bp, Triticum aestivum; identical to SEQ ID NO: 2969

SEQ ID NO: 2971 - DNA, 651 bp, Triticum aestivum; identical to SEQ ID NO: 2968

SEQ ID NO: 2972 - DNA, 651 bp, Triticum aestivum; identical to SEQ ID NO: 2969

SEQ ID NO: 2973 - DNA, 651 bp, Triticum aestivum; identical to SEQ ID NO: 2968

SEQ ID NO: 2974 - DNA, 603 bp, Triticum aestivum
atgacacgcctccactccaccatggcgtgcgcgtgccgcgtccgcatccgctgccgccgcctctcctcctccgccacctcgccgtcctcgcgctcctggtctccccgcgccgccttcgccgcgtccacagagcgcttccgcgccggcacgctcggccggccagacgcacaccgcctgttcgacgaattgctacggcgggacaccctggtccccagctgctccctgaacggcctccttcccgtgctcgcccgcgccacgtcctcggcatcctgcgtcacagatgggcccgccctcgccgtcgccctcttcagccgcgtgctccgagcggaagccggtccgtgggtggcgtgtcccacagtgtgcacctatggcatcctcatggactgttgctaccgtgtgcgtcgcccggacctaggacgagcctcaggacgggcctcaaggcagaccaggtcgtcgccaacaactcgctcaagtgcctctgctacgccaagcggaccgacgaggccgtcggcatgctgcttcatgggatgcccgacctcagctgtatgcctaatgccgtctcatacaacatttcgtaagaggttatctgaggatagaaggagc

SEQ ID NO: 2975 - DNA, 603 bp, Triticum aestivum; identical to SEQ ID NO: 2974

SEQ ID NO: 2976 - DNA, 603 bp, Triticum aestivum; identical to SEQ ID NO: 2974

SEQ ID NO: 2977 - DNA, 603 bp, Triticum aestivum; identical to SEQ ID NO: 2974

SEQ ID NO: 2978 - DNA, 603 bp, Triticum aestivum; identical to SEQ ID NO: 2974

SEQ ID NO: 2979 - DNA, 603 bp, Triticum aestivum; identical to SEQ ID NO: 2974

SEQ ID NO: 2980 - DNA, 708 bp, Triticum aestivum
atggactggccacctagcactggtacaacatggaaaagcactaaccgcatcgatcgtctcccactcgagtcgtcttgctcagcgttcacgacccacacatccaaggccatgcctcgcttctcctccaccccgccaatgtcgccaccccgcctccgcgtcggactcggcgccggccactcctcctccacctctcatccctcacgcatctgggatccccacgccgccttcgccgccgccacggagcgtgcgcgctctggcaacctcaccccggaggacgcacaccacctgttcgacgaattgctccggcagggcaatcctgtccaggagcgccccctcaacaaccttcttgccgccctcgcccgcgctccggcgtccgcggcgtgcagcgatggccctgcactcgcagtcaacctcttcagccgcatatcccaaggcgcccgccgacgtgtggcacacccaacggcctgcacctacagcatcctcatggactgctgctgccgcgtacaccgcctcgatctggcgttcgctttcttcgcccgtctcctcaggacgggacttaaggcaaaccaagtcatcttctgcaccctcctcaagggactctgccatgcaaagcgcacagatgaggctctggacgtgctgctgcacaggatgcctgagctgggctgcacccccaacgcggtggcgtataaccctatctcagtttgtata

SEQ ID NO: 2981 - DNA, 708 bp, Triticum aestivum; identical to SEQ ID NO: 2980

SEQ ID NO: 2982 - DNA, 729 bp, Triticum aestivum
atggattatctttgcaagagcggaagatgcggagaagctaggaagctttttgattctatgatcagtttgggccaaaaaccgacggttactacatacaacattttgctccatgggtatgccatggaaagatattttcatgatatgcattgtctcatcgatttgatggcagaaaatggcatttcaccggatcattatgtctacaacatactgatatttgcatatgctaaagaaaaaatggttggtgaggtaatgcatatatttacaaaaatgcggcaacaaggattcaaccctgatgcagcgagctatgggacgggaataaacttactttgcagcattggccgaatggatgatgctgtgttgcaattcaatcaaatggtaacggaaggattagctcctgatatcatagttttcaccacccttttgagtggtttttgttcttgtggcaaatgggagaaggtccatgaactattttctgaaatgttgaatcgtggaatctatcccaatgctgtgttcttcaacaaaattatgagccccctttgcaaaaatggaagggttatggcagcccaagatctctttgacctgatgatacacatgggtgtaaagccggacatgcatgcttataacacgatgatgggtggatacatgttcgttggcaagatggatgaagtgaggaagttacttgacaatatggtctcaactggcctggaaccagatattttcacatatgga

SEQ ID NO: 2983 - DNA, 729 bp, Triticum aestivum; identical to SEQ ID NO: 2982

SEQ ID NO: 2984 - DNA, 717 bp, Triticum aestivum
atgctattatgtatggtatacttcttaatgatcactgatggattgagtcttttcatggaaatgtcactcagcggggtgaagcccactactattatgtacaacattatacttgatgggctgttttgctctgggagaacagtttctgcaaaggaaaaatttgatacgatgattgaaagtggcataccagtgggcattgacacatacaacatagttcttagtggactttgtaaaaacaattgcactgatgaagcaatagagctattcaagaaattacgtgctatgaacgtgaagattgatgtcataactctcaataccatgatttctgcaatgtttaaaactaggagaattgaagaagccaaggatttgtttgctactatatcagccattgggttagtgccttctgttgtaacttacattttaatgataacgaatttcattaaagaagggctgctagcagaggctgatgatatgtttttagcaatggagaaggctggatgtgctccaaactccagtttgctaaatcaagtggtcagagtgttgctggaaaaaggtgcagctgtacaggctgcaacttatctggctaaaattgatgcaaaacatctgtcacttgaagcttcaacggtttcgttaataatatctctcttctcaaggaaaggggaactatgggagcatgtaaaattgcttccggtaaagtaccagcctcctgagatgttcgac

SEQ ID NO: 2985 - DNA, 717 bp, Triticum aestivum; identical to SEQ ID NO: 2984

SEQ ID NO: 2986 - DNA, 717 bp, Triticum aestivum; identical to SEQ ID NO: 2984

SEQ ID NO: 2987 - DNA, 717 bp, Triticum aestivum; identical to SEQ ID NO: 2984

SEQ ID NO: 2988 - DNA, 717 bp, Triticum aestivum; identical to SEQ ID NO: 2984

SEQ ID NO: 2989 - DNA, 717 bp, Triticum aestivum; identical to SEQ ID NO: 2984

SEQ ID NO: 2990 - DNA, 726 bp, Triticum aestivum
atgatgaacagaggtattcctcattctaacattccattcttcggttccgtaataaagaatctgtgccaagaaggaagggttatggacgcacatgaaatctttgacttggttatagacatgggtgagaggcctgatgacattttatttaattcactgattgttggatactgcttagtcgggaagatggataaagcattaaaagtacttgatgtcatggaatcagttggtgttgagcctgatgttattacatataatacacttgttaatggctattgtaaaagtggaaggatcgatgatggtttcgttctattcagagaaatgccgagtaagagagttaaacctgacactgttacatatggcatcatactggcagggttgtttcgtgcttggagaactgttgatgcaaggacaatgttccatgagatgatcgaaagtggaataacagtggacatcgtcacatacaatataattcttacaggactctgtagaaataattgcatagatgaagcgatcgccctgttccagaaattaggtgtaatgagtgtgaagttcaatattgcaatactaaataccatgatcgatgcaatgtacaaggtttggagaagagaagaagtcagtgatttatttgctgcaatatcagccagcactagtagaaaaacacctattagtcccggttcgttagggcctttagtcctggttcatgaaccgggactaatgggtcgttac

SEQ ID NO: 2991 - DNA, 678 bp, Triticum aestivum
atgggtaaggcagagttgttccttcggcgaatggttgataacagtgttcaaccggatagggtgacatatactagcatgatccatggatattccactttgggccggtggaaagaggcgacgaaaatgttcagagaaatgacaggcaggggccttataccaaatattgtcacttggaactcgttcatggcctccctatgtaagcatggaagaagcaaagaagctgcagaaattttcttttccatggctgcaaagggcaataagcctaatatcatcacctacggtattcttcttcatgggtatggcaatgaaggaagctttgttgatatgatgagtctctttaattcaatgaaaggcaacggtattgtggccaaccgccaggttttcaacatattaattgatgcatatgctaaacgaggactgatagatgaagctgttctcatacttactgaaatgcggggacacggactgagtccggatgtattaccgaaaaagggtttccccccgctttgtatacaaagcaaccaaccgaaccatacagagataggtgttggggcggaagcagcacagtcacgcccaaaagaaacgacagagaaagagcaaaagaaacaaatgccgacaacggcggatcaacaaaaacgaagaagcctcgcgatcgctgcacccaccgggatcttccac

SEQ ID NO: 2992 - DNA, 678 bp, Triticum aestivum; identical to SEQ ID NO: 2991

SEQ ID NO: 2993 - DNA, 678 bp, Triticum aestivum; identical to SEQ ID NO: 2991

SEQ ID NO: 2994 - DNA, 678 bp, Triticum aestivum; identical to SEQ ID NO: 2991

SEQ ID NO: 2995 - DNA, 678 bp, Triticum aestivum; identical to SEQ ID NO: 2991

SEQ ID NO: 2996 - DNA, 678 bp, Triticum aestivum
atgggtaaggcagagttgttccttcggcgaatggttgataacagtgttcaaccggatagggtgacatatactagcatgatccatggatattccactttgggccggtggaaagaggcgacgaaaatgttcagagaaatgacaggcaggggccttataccaaatattgtcacttggaactcgttcatggcctacctttgcaagcatggaaaaagcaaagaagctacagaaattttcttttccatggctgcaaagggcaataagcctaatatcatcacctacggtattcttcttcatgggtatggcaatgaagaaagctttgttgatatgatgagtctctttaattcaatgaaaggcaacggtattgtggccaaccgccaggttttcaacatattaattgatgcatatgctaaacgaggactgatagatgaagctgttctcatacttactgaaatgcggggacacggactgagtccggatgtattaccgaaaaagggtttccccccgctttgtatacaaagcaaccaaccgaaccatacagagataggtgctggggcggaagcagcacagtcacgcccaaaagaaacgacagagaaagagcaaaagaaacaaatgccgacaacggcggatcaacaaaaacgaagaagcctcgcgatcgctgcacccaccgggatcttccac

SEQ ID NO: 2997 - DNA, 555 bp, Triticum aestivum
atggttgaaagtggaacaacagtgagcatttcaacatacggtataattcttggagaactttgtaggaataattgcactgaggaagcaatcatactgttccacaaattaggtgcaatgaacgtgaagttcgatattacaatattcaataccatgattgatgcaatgtacaaggttcgaagaagagaagaagctaacattttgtttgctgcaatatctgccaatggattggtacctaatgcttctacctacagaataatgataacaaatcttttaaaagaaggatcaatggaagaagctgatcatatgttttcatcaatggagacgagtggttatgctcccagctccgttctattaaatgctatcatcagaatgttgttagaaaaaggtgagatagtcaaggctggaaattatttgtctaaagttgatgggaagagcatctcacttgaagcttcaactagtttgttgatgtggcatctattttcaacggaaggaaaatatcatgagcaaataaaatcactccctgaaaggtatcgatttttcggagtcagacacagt

SEQ ID NO: 2998 - DNA, 555 bp, Triticum aestivum; identical to SEQ ID NO: 2997

SEQ ID NO: 2999 - DNA, 555 bp, Triticum aestivum; identical to SEQ ID NO: 2997

SEQ ID NO: 3000 - DNA, 555 bp, Triticum aestivum; identical to SEQ ID NO: 2997

SEQ ID NO: 3001 - DNA, 555 bp, Triticum aestivum; identical to SEQ ID NO: 2997

SEQ ID NO: 3002 - DNA, 555 bp, Triticum aestivum; identical to SEQ ID NO: 2997

SEQ ID NO: 3003 - DNA, 555 bp, Triticum aestivum; identical to SEQ ID NO: 2997

SEQ ID NO: 3004 - DNA, 663 bp, Triticum aestivum
atgccccgcctccgcctccgtcgcttctccaccgcgccgatgttccacctcctccgccgcagctcctcctccacctccacctcgccgccctcgcgttcctggtctccccacgccgcctttgccgccgcgacggagtgtgtccgtgccgggacgctcagccctgaagacgcgcaccacctgttcgacgaattgctacggcaggccaccccggtccccgagcgccccctcaacggcttccttgccgccctcgcccgtgcgcccgcctcggccgcctgcattagagatggccccgcccttgccgtcgctctcttcaaccgcgtgtgccgagaagaagccggcctgcaggtggcagcgcccacagtttgcacctacaacatcctcatggactgctgctgccgcgcgcatcgcccggacctagggcttgccttctttggtcgtttcctcaggacaggcctgaagacagaacagatcaccgtcagcaccttcctcaagtgcctctgctacgccaaacggacggaagaggctgtgaacgtgctgcttcatgggatgtccgagctcggctgtgtgccgaatgcaatctcatactccattgttctgaagagcttatgcaagaatagcatgagtcagcgggcactcgacctgctctttcagtgtggtggcata

SEQ ID NO: 3005 - DNA, 663 bp, Triticum aestivum; identical to SEQ ID NO: 3004

SEQ ID NO: 3006 - DNA, 663 bp, Triticum aestivum; identical to SEQ ID NO: 3004

SEQ ID NO: 3007 - DNA, 534 bp, Triticum aestivum
atggacatggcacttcggataatgcccaagtttaactgcataccggatgttttctcctacaacattcttttcaagggtctatgcaccgagaaaagaagccaagaggctctagagctgattcacgtcatggctgaggatggaggtagctgccaacctaatgtggtgtcctatagcaccgtagttgatggcttgttgaaagagggtgaggtggacaaagcttacagcctattttgtcaaatgctaaagaggcgaatttcgccgaatgttgtgacctgtagttcaatcatctctgtcatgtgcaaggttcatgcgatggacaaggctgagcaggttcttcaacagatgtttgatacaagaattctgccaaatgttgctacatatactagtctgatacaaggatactattcattaggacactgcgaagaggtggattggattttcaagaaaatgtctagaaatggtgttcaaccaaatattgtagcttacaaacatacggatggattatctttgcaagagcggaagatgcgcataagc

SEQ ID NO: 3008 - DNA, 534 bp, Triticum aestivum; identical to SEQ ID NO: 3007

SEQ ID NO: 3009 - DNA, 534 bp, Triticum aestivum; identical to SEQ ID NO: 3007

SEQ ID NO: 3010 - DNA, 534 bp, Triticum aestivum; identical to SEQ ID NO: 3007

SEQ ID NO: 3011 - DNA, 534 bp, Triticum aestivum; identical to SEQ ID NO: 3007

SEQ ID NO: 3012 - DNA, 534 bp, Triticum aestivum; identical to SEQ ID NO: 3007

SEQ ID NO: 3013 - DNA, 591 bp, Triticum aestivum
atgacctccacgccgatgcgccggctcctcctctgtcgccgctcctcctcctcctccacctccacttcaccgccctcacgcccctggtctccccacgccgcctttgccgctgccacatggacgctcaccccgaaacacgcacaccacctgttcgacgaattgctacggcaggacactccggtccccgagcgctccctggacggcttccttgccgctctcacccgtgctagttcctctgcgtcctgcagagatggccccgccctcgcgctcgacctcttcagccacttgtgccgcgaagaagccggccctcgggtggcgccgcccacaatctttacctacggcgttctcatgaactgctgctgccgcactcgtcgctcgcaactggggcttgccttcttcggccgtctcctcaggacgggcctgaagacaaacacgatcgtcttcagctccctcctcaagtgcctctgccacgccaaatgggcagacgaggctgtcagcgtgctgcttcataggatgtccgagctcggttgtgtgcctgatgccttctcatacaccattgttcttaagagcttatgtgatgctagcagcagc

SEQ ID NO: 3014 - DNA, 591 bp, Triticum aestivum; identical to SEQ ID NO: 3013

SEQ ID NO: 3015 - DNA, 591 bp, Triticum aestivum; identical to SEQ ID NO: 3013

SEQ ID NO: 3016 - DNA, 591 bp, Triticum aestivum
atgacctccacgccgatgcgccggctcctcctctgtcgccgctcctcctcctcctccacctccacttcaccgccctcacgcccctggtctccccacgccgcctttgccgctgccacatggacgctcaccccgaaacacgcacaccacctgttcgacgaattgctacggcaggacactccggtccccgagcgctccccggacggcttccttgccgatctcacccgtgctagttcctctgcgtcctgcagagatggccccgccctcgcgctcgacctcttcagccacttgtgccgcgaagaagccggccctcgggtggcgccgcccacaatctttacctacggcgttctcatgaactgctgctgccgcactcgtcgctcgcaactggggcttgccttcttcggccgtctcctcaggacgggcctgaagacaaacacgatcgtcttcagctccctcctcaagtgcctctgccacgccaaatggacagacgaggctgtcagcgtgctgcttcataggatgtccgagctcggttgtgtgcctgatgccttctcatacaccattgttcttaagagcttatgtgatgctagcagcagc

SEQ ID NO: 3017 - DNA, 591 bp, Triticum aestivum; identical to SEQ ID NO: 3013

SEQ ID NO: 3018 - DNA, 591 bp, Triticum aestivum; identical to SEQ ID NO: 3016

SEQ ID NO: 3019 - DNA, 663 bp, Triticum aestivum
atgtcactcagcggggttaagcccacgactattatatacaacattatactggatgggctgttttgctctgggagaacaggttctgcaaaggaaaaattccatacgatgactgaaagtggcataccagtaggcgttgacacatacaacatagttcttagtggactttgtagaaacaattgcactgatgaagcaatagaactgttcaagaaactacgtgcaacgaacgtgaagattgatgtcatgacactcaatatcatgatttctgcaatgtttaaaactaggagaattgaagaagccaaggatttgtttgctactatatcagccatagggttggtgccttctgttgtgacttacagtgtaatgatgacgaatttcataaaagaagggtcgctggcagaggctgatgatatgtttttagcaatggagaaggctagctgtgctcccaactccatcctgctaaatcaagtggtcagggcgttgctggaaaaaggtgcagttgtaaaggctgcaacttatctcgctaaacttgatgctaaacagctgtcagttgaagcttcaacgatttcgttaatagtatctctcttctcaggggaagggaaactaagggagcacgtagagttgcttccagtaaagtaccagcctcctgagagttcgactgacaat

SEQ ID NO: 3020 - DNA, 663 bp, Triticum aestivum; identical to SEQ ID NO: 3019

SEQ ID NO: 3021 - DNA, 663 bp, Triticum aestivum; identical to SEQ ID NO: 3019

SEQ ID NO: 3022 - DNA, 663 bp, Triticum aestivum; identical to SEQ ID NO: 3019

SEQ ID NO: 3023 - DNA, 501 bp, Triticum aestivum
atgtatatgtttgacttcattctaggtattggtcagcggcctgatgtgattatgtacaattcattgatggatggatattgccttgttggcaaggtggaggaagcagtgagagtacttgatgctatgaagtctgctggcctccaacctactactgttacgtatggtatacttcttaatggctactgtaaaattggaaggatcgccgctggattgagtcttttcaaggaaatgtcactcagcggggttaagcccattactattatgtacaacattatacttgatgggctgttttgctctgggagaacagtttgtgcaaaggaaaaattccatacgatgaatgaaagtggcataccagtgggcgttgacacatacaacatagttcttagtggactttgtaaaaacaattgcactgatgaagcaatagagctgttcaaggaattacgtgctaagaacgtgaagattaatgtcatgatactcaatactatgattttttgcaatgtt

SEQ ID NO: 3024 - DNA, 501 bp, Triticum aestivum
atgtatatgtttgacttcattctaggtattggtcagcggcctgatgtgattatgtacaattcactgatggatggatattgccttgttggcaaggtggaggaagcagtgagagtacttgatgctatgaagtctgctggcctccaacctactgctgttacgtatggtatacttcttaatggctactgtaaaattggaaggatcgccgctggattgagtcttttcaaggaaatgtcactcagcggggttaagcccactactattatgtacaacattatacttgatgggctgttttgctctgggagaacagtttgtgcaaaggaaaaattccatacgatgaatgaaagtggcataccagtgggcgttgacacatacaacatagttcttagtggactttgtaaaaacaattgcactgatgaagcaatagagctgttcaaggaattacgtgctaagaacgtgaagattaatgtcatgatactcaatactatgattttttgcaatgtt

SEQ ID NO: 3025 - DNA, 501 bp, Triticum aestivum; identical to SEQ ID NO: 3024

SEQ ID NO: 3026 - DNA, 501 bp, Triticum aestivum; identical to SEQ ID NO: 3024

SEQ ID NO: 3027 - DNA, 501 bp, Triticum aestivum
atgtatatgtttgacttcattctaggtattgctcagcggcctgatgtgattatgtacaattcattgatggatggatattgccttgttggcaaggtggaggaagcagtgagagtacttgatgctatgaagtctgctggcctccaacctactactgttacgtatggtatacttcttaatggctactgtaaaattggaaggatcgccgctggattgagtcttttcaaggaaatgtcactcagcggggttaagcccattactattatgtacaacattatacttgatgggctgttttgctctgggagaacagtttgtgcaaaggaaaaattccatacgatgaatgaaagtggcataccagtgggcgttgacacatacaacatagttcttagtggactttgtaaaaacaattgcactgatgaagcaatagagctgttcaaggaattacgtgctaagaacgtgaagattaatgtcatgatactcaatactatgattttttgcaatgtt

SEQ ID NO: 3028 - DNA, 501 bp, Triticum aestivum; identical to SEQ ID NO: 3027

SEQ ID NO: 3029 - DNA, 618 bp, Triticum aestivum
atgacaggaagatgggacccacacactctcggctgtgcaactccaaactctcttcgctgcgtacgaacacggcggccgttccggacgccgcccagacgaagtctggtctctgactccgccattccttttctcctgacctccgcacctcgccgatgtcccgcctccgccgctcctccgccacgccgatctccagcctccacctcctccgccacatctcctcctccacctccacccccacccccacgtcgccaacctcacgctcctggtcaccccatgccgcctttgccgcggccacgcagcgtgtccgtgccgggacactcaggccggaagacgcacacaacatgttcgacgaattgcttcggcaggccatcccggtccctgaacggcttccttgccgtcctcgcccgtgtgcccgcctccggcgtctgcatcagagatggccctgccctcgcagtgtctctcttcaaccgtgtgtgcagagaggaagctggcccgcaggtggcgaggctcacagtttgcacctacaacattctcatggactgctgctgccgtgcgcgtcgcccggagctagggcttgccttattccgccgcttcctcaggaagggcctgaagacagac

SEQ ID NO: 3030 - DNA, 618 bp, Triticum aestivum; identical to SEQ ID NO: 3029

SEQ ID NO: 3031 - DNA, 618 bp, Triticum aestivum; identical to SEQ ID NO: 3029

SEQ ID NO: 3032 - DNA, 684 bp, Triticum aestivum
atggtgagcatcggcgagcatgcttgtcctcctaactctgctttccttcttcctaatcccaattcatgcccaggttgcgccggtgcggtggggggcgagcggcaccggcgtcctctgggtcctctgccattaccagattcttccagatccataggtggagctatgagccgccgcgccgtccccgctggcaggcgcatcttggagcagaacatcaagtcccggtaccgggctggagccattggcaccgacgatgcactccacctgtttgacgaattgctccaggttgcctggccctcctcgatcgccgccatcaactgcctcctcattgtcgtcggccgtgattgccctgcgctcgctgtctccctcttcaaccacatcgcaagagccaaggtggcgccccacaatatcacctacggcattctagtcgactgctgcagccgtgctggccgttggaccttggcttcgctgccatgggccacatcgttaagacgggatttgcggcaggatccgttgtctctttcagccacctgctcagggccgtctgtgcggagaagaagaccagctacggaatggacatcgtgctccgaattatgcctgagcttaactgcataccggatgtttactcctacaacattcttttcaagggcctctgcaacgagaagagaagccaagaggctctcgagc

SEQ ID NO: 3033 - DNA, 684 bp, Triticum aestivum; identical to SEQ ID NO: 3032

SEQ ID NO: 3034 - DNA, 684 bp, Triticum aestivum; identical to SEQ ID NO: 3032

SEQ ID NO: 3035 - DNA, 660 bp, Triticum aestivum
atgatttctactgatataaaaccggacacggttgtttatcactccctaattcagggtttctgcacacatggcgatttggtgaaagcaaaggagttggtttatgaaatgataaacaaagacattcctcctcctactattgtgctcttcagttcaataataaatagtctatgcaaagaaggaagggttacagatgcacaagatatcttcaacttggttattgaaataggtgagagtcctgatgtctttgcttttacttcactacttgacggatattgcctagtcggcaaaatggagaaagcatcacaagtgtttgatgcaatggtatcagctggcattgagcctaatgcatccacctacagcgtaatgataacaaatcttttgaaacaaggattagtggaagaagctgaaagtatgttctcatcaatggagaagagcggttgtgctccggactctcctcttatgaatgatatcatcagaatattattggaaaaaggtgaaattgttaaggctggagattatatgtctaaagttgatggcaggagcatctcacttgaagctacaactacttcattgttgaaatgtctcttttcaagcaaagggaaatatcgggaacaaataaatttgctccctgtaaagtaccagtttttcaatggagccagt

SEQ ID NO: 3036 - DNA, 660 bp, Triticum aestivum; identical to SEQ ID NO: 3035

SEQ ID NO: 3037 - DNA, 450 bp, Triticum aestivum
atgggatctggggtcctcccggtcgcccacacggggggcggctcgggagggggaactagtatatctctgattttgtcgtggcttttatgcactttaccacatttgtatatgtattggcctttgaccctcggtaaagcttacttgctcacttatccaacaattggcacgggagtacaaccgaacacagttgtttatcactccctagttcagggcttatgtacacatggtgatttggcgaaagcggaggagttagtttctgaaatgatgaataaaggtattgctcgtccaaacaaatcgttagcttcttcctttttgtatcattactccataagtggaagcattaggcgagttggtgccaaccctgcgtatatccgtgtatctatttgccagcatatatccgtgtgtgacaaccctgcggagacaatccgttgcagttgtcatccttctttt

SEQ ID NO: 3038 - DNA, 450 bp, Triticum aestivum; identical to SEQ ID NO: 3037

SEQ ID NO: 3039 - DNA, 450 bp, Triticum aestivum; identical to SEQ ID NO: 3037

SEQ ID NO: 3040 - DNA, 672 bp, Triticum aestivum
atggttcataatggtgtccaaccagatgctgtgacatataatagcttgatccaaggatattcaactctgggacagttgaaagaactcgttaggttgttgaaagtgatgagaagccaaggtgttctaccagatgttgttacctacaactcactcatgacctgcctttgcaagaatggaagattcaaggaagctgtagaaattttttattccatggctgtgaagggccaaaaacctaatgtcgtctcatactctataatgctccatgggtacgctatacaaggatcccttgttgaaatgattgacctctgtgagctgatggcaagagatggagttgtacccgacctccattgtttcaacatactgattagtgcatatgctaagtatggaaggatggatgtggctatgcttttcttcgaagacatgttgaagaaggggttgaaccctaatgaatttatttatttaactgtcatatctgcattttgcaagatgggcaggatggatgatgctctggaaaaattcaatgagatgattgataggggagtaccacttgacacaaaaatttacgtgtgcatgattgagggttatttgaatcatggtgaatctgtgaaagccgaggaatttattaccaaaatgaagagcagggatattcgtcatgggccgcggaagggtaat

SEQ ID NO: 3041 - DNA, 615 bp, Triticum aestivum
atgtctcgcctccgcctccgcctcccccgcggcagctcctcctccaccacagtgatcccccgcctccgactactccgccgctgctcctcctccacctccacctcgccgccctcacgctcctggtctccccgagacgcctttgccgcggccacgcagcgtgtccgcgctgggacgctcaggccggaagacgcacacaacctgttcgacgaattgcttcggcaggccaccccggtccccgagcgctccctgaacggcttccttgccgccctcgcccgtgcgcccgtgtccggcgcctgcatcagagatggctccgcccttgcagtgtctctcttcaaccgtgtgtgcagagaggaagccggcgcgcaggtggcggcgctcacaggctgcacctacagcatcctcatggactgctgctgccgtgcgcgtcgcccggacctggggcttgccttattcggccgcttcctcaagaaaggcctgaagacagaccagattgtcgccagcaccttcctcaagtgcctctgctacgcaaaacggactgatgaggctgtgaacgtggtacttcataggatgtccgagctcggctgtgtgcctaatgccttatcgacctgctccaga

SEQ ID NO: 3042 - DNA, 615 bp, Triticum aestivum; identical to SEQ ID NO: 3041

SEQ ID NO: 3043 - DNA, 615 bp, Triticum aestivum; identical to SEQ ID NO: 3041

SEQ ID NO: 3044 - DNA, 615 bp, Triticum aestivum; identical to SEQ ID NO: 3041

SEQ ID NO: 3045 - DNA, 588 bp, Triticum aestivum
atgtttcatcagatgatcaaaagtggaataacagtgcccgtttccatatacactataattcttagaggactttgtaaaaataattgcgctggcgaagcaatcaccatgttccaggaattacgtgcaatgaatgtgaagtttgatatcataacactcaataccatgattaatgccatgtacaaggttcagagaagagaagaagctaaaggtttgtttgctgcaatatcagccagtgggttgatgcctgatgcttatacttacaacgtaatgataaacaatcttctaaaagaaggatcagtggaagaagttgacaatatgttttcattgatggagaagagtggttgtgctcccagctctcatcttgtaaatgatatcatcagaaggttgttggaaaaaggtgagattgccaaggctggaaattatttgtctaaagttgatgggaagatcatctcacttgaagattcaaccatttcattgttgtcgtctcttttttcaagcaaagggaaatatcgggagaacatcaagttacttcctgcaaattatcactttttagatggatttagtggcattgcacatgagactaactcc

SEQ ID NO: 3046 - DNA, 588 bp, Triticum aestivum; identical to SEQ ID NO: 3045

SEQ ID NO: 3047 - DNA, 588 bp, Triticum aestivum; identical to SEQ ID NO: 3045

SEQ ID NO: 3048 - DNA, 588 bp, Triticum aestivum; identical to SEQ ID NO: 3045

SEQ ID NO: 3049 - DNA, 588 bp, Triticum aestivum; identical to SEQ ID NO: 3045

SEQ ID NO: 3050 - DNA, 588 bp, Triticum aestivum; identical to SEQ ID NO: 3045

SEQ ID NO: 3051 - DNA, 561 bp, Triticum aestivum
atggttgaatctggagtaagtgtgtgcattgatacatattcgatagttcttggtggactttgtagaaataattgtagcggcgaagcaatcatgctattccagaaattaagcacaatggatgtgaaattcaatattataattgtcaatataatgattgatgccttctacaaggttcagcgaaaccaagaagccaaggatttgtttgctgcagtatcagcgaatggtttggtagctaatgtctttacctacaccataatgatgaaaaatcttataaaagaagggtcagtggaagaagctgacgatctctttttatcaatggagaagagcggctgtactgctgactcttatatgttaaatcttatcgtcagaatgttacttgaaaaaggagagctagtcaaggctgggaattatatgtctaaagttgatgcaaagagctactcacttgaagctgaaaccgtttcgctgcttatctctctcttttcagggaaagggaaatatagagaacacataggattgctccctacaaagtatcagtttcgtgaagaagcggccgcagttgaa

SEQ ID NO: 3052 - DNA, 636 bp, Triticum aestivum
atgtcacgccgctataccatcacactgatctcccgcctccgagtcccccgccgctgctcctcctccacctccatctcgccgccctcacgctcctggtctccccgcgacgcctttgccgcggccacagagcgcgtgcgcgccggcacgctcagcccggaagatgcacacaacctgttcgatgaattgctgcggcagggcactccggtccccgagcgctccctgaacggcttccttgccgccctcacccgtgctacgtcctccaatgcctgcatcaaagatggccccgccctcgcccttgctctcttcacccgagggtgcagagaagaagccggcccgcaggtggcggtgcccaccgtttggacctacaacatcctcatggactgctgctgccgcgcgcgtcgcccagacctagggctcgccttattcgggtgtatcctcaggacggggttgaagatagaccaaatcaccgccaacaccctcctcaagtgcctctgctatgcgaaacggacagaagaggctgtgtacgtgctgcttcatagtatgtccaagctcggatgtgtgcctgatgccttcgcatacaacatagttcttaagagcttatgtgtgttaggaaagcaacttgtattcccatggcca

SEQ ID NO: 3053 - DNA, 636 bp, Triticum aestivum; identical to SEQ ID NO: 3052

SEQ ID NO: 3054 - DNA, 636 bp, Triticum aestivum; identical to SEQ ID NO: 3052

SEQ ID NO: 3055 - DNA, 636 bp, Triticum aestivum; identical to SEQ ID NO: 3052

SEQ ID NO: 3056 - DNA, 633 bp, Triticum aestivum
atgtcacgccgctataccatcacactgatctcccgcctccgagtcccccgccgctgctcctcctccacctccatctcgccgccctcacgctcctggtctccccgcgacgcctttgccgcggccacagagcgcgtgcgcgccggcacgctcagcccggaagatgcacacaacctgttcgatgaattgctgcggcagggcactccggtccccgagcgctccctgaacggcttccttgccgccctcacccgtgctacgtcctccaatgcctgcatcaaagatggccccgccctcgcccttgctctcttcacccgagggtgcagagaagaagccggcccgcaggtggcggtgcccaccgtttggacctacaacatcctcatggactgctgctgccgcgcgcgtcgcccagacctagggctcgccttattcgggtgtatcctcaggacggggttgaagatagaccaaatcaccgccaacaccctcctcaagtgcctctgctatgcgaaacggacagaagaggctgtgtacgtgctgcttcatagtatgtccaagctcggatgtgtgcctgatgccttcgcatacaacatagttcttaagagcttatgtgtgttaggaaaacttgtattcccatggcca

SEQ ID NO: 3057 - DNA, 633 bp, Triticum aestivum; identical to SEQ ID NO: 3056

SEQ ID NO: 3058 - DNA, 669 bp, Triticum aestivum
atgtcgcgcctccagccccgctctttctccagctccgcctcctcacgcgccaacgagctgctagacgaattcaaatatcatctgggctccgggacgctctggccggagctcgcgcaccaactgttggacgaattgcagcgccaacccgtcccggtttcagcgcgcgcactaaatggcttgtttgctgccctcgcggatgcgccgccctcggccaactgcacagatggccctgccctcgccatcaatctcttcaaccgccaccggatatcacctgacatttacacctacaacatactaattgagtgctgccaccgagcatgccgcccagaccttggacctgccttcttcggccgcctcctcaagacaggcgtcacaatgagtgtcattacctacagcagctatggcgaaagctttggggtggatcctctcccttccgcctcctcctcgagctatggcgaaagcttttgttcccctggtctgggcgtcgacggcaccctggtgtcgtgctccttcttgaaggcggcggctgggaacagctcttggtggcggggctgctggtggcgtggtggcttcggccttctacttggtgctgcgccttgcttcgcgggaccagcggacggtttctttggtggagcggtgctgcatccattcattgatggcgacggatct

SEQ ID NO: 3059 - DNA, 669 bp, Triticum aestivum; identical to SEQ ID NO: 3058

SEQ ID NO: 3060 - DNA, 669 bp, Triticum aestivum; identical to SEQ ID NO: 3058

SEQ ID NO: 3061 - DNA, 669 bp, Triticum aestivum
atgtcgcgcctccagccccgctctttctccagctccgcctcctcacgcgccaacgagctgctagacgaattcaaatatcatctgggctccgggacgctctggccggagctcgcgcaccaactgttggacgaattgcagcgccaacccgtcccggtttcagcgcgcgcactaaatggcttgtttgctgccctcgcggatgcgccgccctcggccaactgcacagatggccctgccctcgccatcaatctcttcaaccgccaccggatatcacctgacatttacacctacaacatactaattgagtgctgccaccgagcatgccgcccagaccttggacctgccttcttcggccgcctcctcaagacaggcgtcacaatgagtgtcattacctacagcagctatggcgaaagctttggggtggatcctctcccttccgcctcctcctcgagctatggcgaaagcttttgttcccctggtctggacgtcgacggcaccctggtgtcgtgctccttcttgaaggcggcggcggggaacagctcttggtggcggggctgctggtggcgtggtggcttcggccttctacttggtgctgcgccttgcttcgcgggaccagcggacggtttctttggtggagcggtgctgcatccattcattgatggcgacggatct

SEQ ID NO: 3062 - DNA, 267 bp, Triticum aestivum
atgaactgctgctgccgcgtgcgtcgtcccgacctagggcttgcctacttcggccgcctcctaaggaccggcctcaagacaaatgaggttgtcgccagcaccgtcctcaagtgcctttgcttcgcaaaacggacagacgaagctgtggacgtgctgcttcataggacgtctgtcctcggctgtgtgcctaattccttctcatacaacatagttctaaagagcttatgtgagacagcaggagccagcaagcgctcggcctgctcgagg

SEQ ID NO: 3063 - DNA, 660 bp, Triticum aestivum
atgccacgcgtccgacccggctcctcctccggcaccgtctcctcacacgccaaccagctgctaaacaagctcaaggatcatgtcggctctgggacactccagccggagcgcgcacaccaactgtttgacaaattgctgcgccaagctgttcccatatctgcgtgcgcactcaatggcttatttgccgccctcgcgcgtgcgctgccctccgctgcctgcaccgacggccctgctctagccattgctctcttcaaccgcatggctcgagagggccgctgggtgatagcgcccaacatgtacacctacaccatactaattgactgcagctgccgctcgcgccgccctgacctagggcccgccttcttcggccgcctcctcaagacaggcatcacggcggacgtctgcaccttcagcagcttattcaagtgcctctgtgacatgaagcggatagacgaggctgtgggagtgctgcttcacaggatgcccggagacatgcctgatgtcatctcctactcaacaatcctcaagggcttctgcaacgaggggaggagccagcttgcacttgatctgctccagatgatggtcaaaaaaggagctggccagtcacccgacgtggtatcatacaacatggtaatcaatggcttctttaaggaggtgaag

SEQ ID NO: 3064 - DNA, 660 bp, Triticum aestivum; identical to SEQ ID NO: 3063

SEQ ID NO: 3065 - DNA, 660 bp, Triticum aestivum; identical to SEQ ID NO: 3063

SEQ ID NO: 3066 - DNA, 660 bp, Triticum aestivum; identical to SEQ ID NO: 3063

SEQ ID NO: 3067 - DNA, 660 bp, Triticum aestivum; identical to SEQ ID NO: 3063

SEQ ID NO: 3068 - DNA, 660 bp, Triticum aestivum; identical to SEQ ID NO: 3063

SEQ ID NO: 3069 - DNA, 588 bp, Triticum aestivum
atgacacgcctctactccaccacggcgtgcgcgcgccgcgttcgcatccgctgctgctgccgcctctcctccaccacctcgccaccctcgcgcacctggtctccccgcgccgccttcgccgtggccacagagcacgtccgagccggcacgctcagccgaccagacgcacatcgcctgttcggcgaattgctacggcgggacaccccggtccccagccgctccctgaacggcctccttcccgtgctcgcccgctccacgtcctccgcgtacgtcccgcgtcacagatgggcccgccctcgccgtcgccctcttcaaccgcatgcgccgagcggaagccggcccgcttgtggcgcgtcccgcagtgtacacctcctcatggactgctgctgccgcgcgcgtcgcccggaccttgggctcgccttcctcggccgtctcctcaggacgggcctcaagacagaccaggtcgtcgccaacaacttcctcaagtgcctctgctacgccaagcggaccgacgaggacgtcgacgtgctgcttcataggatgcccgacctcggctgtgtgcctaatgccgtctcatgcaacatacag

SEQ ID NO: 3070 - DNA, 627 bp, Triticum aestivum
atgtctagaaatggtgttgaaccaactatgataacttacaatatacagatggattatctatgcaagagcggaagatgcatagaagctaggaagatgtttgattccatggtcagtttgggacaaaaaccgactgttactacctacaacattctgcttcatggatatgctatggaaagatcttttcatgatatgaattgtctcattgagttgatggattataatggtattaaaccagatcattatggctacaataaactcatatcttcatctgctaaaaaagaaatggttggtgaggtattgcatatatttacaaaaatgcggcagcaaggattgaaccctaatgttgtgaactatggaacggtaataaacttgctttctagtattggccgaatggatgatgctatgtcccaattcaatcaaatgataactgaagggttagctcctgatatcatagtttcaactcccttattagtggtttctgttcttgtggcaaatgggagaaggttcatgaactattttctcagatgttggatcgcggcatctgtccagacacagtgttcttcaacactgttatggatcacctttgcaaaaatggaagggttatggaagcccaagatgtgttcgacc

SEQ ID NO: 3071 - DNA, 627 bp, Triticum aestivum; identical to SEQ ID NO: 3070

SEQ ID NO: 3072 - DNA, 627 bp, Triticum aestivum; identical to SEQ ID NO: 3070

SEQ ID NO: 3073 - DNA, 624 bp, Triticum aestivum
atgtacaaaattatacttgatgggctgttttgctctgggagaacagtttgtgcaaaggaaaaattcaatacgatgactgaaagtggcataccagtgggcgttgacacatacaacatagttcttagtggactttgtagaaacaattgcactgatgaagcaatagagctgttcaagaaactacgtgcaacgaacgtgaagattgatgtcataacattcaataccatgatttctgcaatgtttaaaactaggagaattgaagaggccaaggatttgtttgctactatatcagccattgggttggtgccttctgttgtgacttacagtgtaatgatgacgaatttcataaaagaagggttgctggcagaggctgatgatatgtttttaacaatggagaaggctagctgtgctcccaactccagtctgctaaatcaagtggtcagggcgttgctggaaaaaggtgcagttgtaaaggctgcaacttatctcgctaaacttgatgctaaacagctgtcagttgaagcttcaacgatttcgttaatagtatctctcttctcaagggaagggaaactaagggagcatgtagagttgcttccagtaaagtaccagcctccggagatgtccgtc

SEQ ID NO: 3074 - DNA, 642 bp, Triticum aestivum
atgccacgcgcccgaccgggctcctcctccagctccgtctcctcacgcgccgaccagctgctaaataaactcaaggatcatctgggccctaggacgctccagccggagcgcgcacaccaactgttcgacaaattgctgcgccaaaccgttccggtatcagcgttcgcactcaatggcttatttgccgtccttgcgcgtgcactgccctccgctgcctgcaccgatggccctgctctagccattgctctcttcaaccgaatgaaccgagagggccaccaggtaatagcgcccaccaatcacgcctacaacatactaattgactgctgctgccgctcgcgcttcccgggcctagggcctgccttctttggccgcctcctcaagacaggcatcaaggcgaacatcatcaccttccacagcctattcaagtgccagtgtgacatcaagcagatggaggaggccctcaacaggctgctctacaggatacctgagctgcctgatagcatctcctactcaataattattaagagcttatgtgacaatgggaggagccaatgtgcacttgacctgctccggatgaaggcgaaaaagggagctgaccactaccctgaagtggtggcatacaacagggtggagccaatggct

SEQ ID NO: 3075 - DNA, 642 bp, Triticum aestivum
atgccacgcgcccgaccgggctcctcctccagctccgtctcctcacgcgccgaccagctgctaaataaactcaaggatcatctgggccctaggacgctccagccggagcgcgcacaccaactgttcgacaaattgctgcgccaaaccgttccggtatcagcgttcgcactcaatggcttatttgccgtccttgcgcgtgcactgccctccgctgcctgcaccgatggccctgctctagccattgctctcttcaaccgaatgaaccgagagggccaccaggtaatagcgcccaccaatcacgcctacaacatactaattgactgctgctgccgctcgcgcttcccgggcctagggcctgccttctttggccgcctcctcaagacaggcatcaaggcgaacatcatcaccttccacagcctattcaagtgccagtgtgacatcaagcagatggaggaggccctcaacaggctgctctacaggatacctgagctgcctgatagcatctcctactcaataattattaagagcttatgtgacaatgggaggagccaatgtgcacttgacctgctccggatgaaggcgaaaaagggagctgaccactaccctgaagtggtggcatacaacagggaggagccaatggct

SEQ ID NO: 3076 - DNA, 642 bp, Triticum aestivum; identical to SEQ ID NO: 3075

SEQ ID NO: 3077 - DNA, 642 bp, Triticum aestivum; identical to SEQ ID NO: 3075

SEQ ID NO: 3078 - DNA, 642 bp, Triticum aestivum; identical to SEQ ID NO: 3075

SEQ ID NO: 3079 - DNA, 642 bp, Triticum aestivum; identical to SEQ ID NO: 3075

SEQ ID NO: 3080 - DNA, 567 bp, Triticum aestivum
atgtcgccgctccgcctccggccccgcctccggccccgcctccatgcccgccgctcctactccacctcgcatcccccacgcagccagggctgggatccccacgccgccttcgctgctgccacggagcgcgcgcgatctggcaacctcacctcgaaggacgcacaccacctgttcgaccaattgctcctgcaggctaatccggtcaacatgcgccctccgaacgatcttctcaccgccctggctcgcgcgcctgcgtccgcagcctgcagcaacggccccgccctcgccgtcgccctcttcagccgtttgtcccaaggtgcccgccaacgggtggtgcagccaacggcctgcacccacggcatcctcatggactgctgctgccgcgcgaaccgccaggatctggcgctcgccttcttcggccgtctcctcaggacgggactgaaggcaggcgtcatagaagtcaacactcttctcaagggactctgccgcgcaaagcgggctgatgaggctctggacattctgcttcacaggatgcctgagcttggctgcacccctgacgtggtggcg

SEQ ID NO: 3081 - DNA, 567 bp, Triticum aestivum; identical to SEQ ID NO: 3080

SEQ ID NO: 3082 - DNA, 534 bp, Triticum aestivum
atgattgatacaggagtacgacagggcacatctgtttatggttctctaatccagggtttttgtacacacggcgatttggtgaaaggaaaggaattggttactgaaatgatgaacaaaggtataccacctcctgatattaagttcttccattcaatcatgcagaacctatgcacagaaggaagggtaatagaagcacgagatatccttgacttgatagcgcagataggtatgaggcctgatgtttgcacatttaatttactgatcggtggatacttcctagtccgcaagatagagcatacatcaaaaatatttgatgatatggtgtcatatggtttaaaaccttgtaatattacatatggtatacttattaatggctattgcaaaaatggaaggattgatcacgggctgattctgttcaaagatatgttgcgcaagggacttaaaccaacaacttttaattacagcccctcgcccctcgcgtcgcccccgtggaattcactcaattccaaaatattttatattttatatttgtac

SEQ ID NO: 3083 - DNA, 576 bp, Triticum aestivum
atggacaaggcagaggtggtccttcgacaaatggttggtaatggtgttcgaccggatattttcacatatactagcctgatccatggatattccatttcgggccagtttgaagaggtcgttaggttgttggaaaaaatgagaagtcaaggtgtcaaaccaactgtttttacttgcaacacagtcatggactacctttgcaagcatggaagaatcaaagaagctgcagaatttttttattccatggctgagaagggtcataaacctaatacagtctcatacgctattatgcttcatgggtacgctaaagaaggatcccttgttgatatgactaatctctgtgagctgatggctggagatggtatcatacccaacatctgtattttcaacatattgattagtgcatatgctaagtgtggaattatggatgtggctatgcttttcttcgaagacatgttgaagcagggagtgaaccctgatgaagtcacgtatttagctatgatagctgggtattgcagtatgggcagtatagtattagtaagtctgacgtgtgctaagatttcagaatataacagaagt

SEQ ID NO: 3084 - DNA, 576 bp, Triticum aestivum; identical to SEQ ID NO: 3083

SEQ ID NO: 3085 - DNA, 576 bp, Triticum aestivum; identical to SEQ ID NO: 3083

SEQ ID NO: 3086 - DNA, 576 bp, Triticum aestivum; identical to SEQ ID NO: 3083

SEQ ID NO: 3087 - DNA, 576 bp, Triticum aestivum; identical to SEQ ID NO: 3083

SEQ ID NO: 3088 - DNA, 576 bp, Triticum aestivum; identical to SEQ ID NO: 3083

SEQ ID NO: 3089 - DNA, 555 bp, Triticum aestivum
atgtcgccactgcgcctccgcctccgcctgcacgcccgccactcctcctccgcctcgcaaccctcacgccgccagggatgggatccccacgccgccttcgccgccgccacggagtgcgcgcgctccggcaacctcaccccggaggacgcacaccacctgttcaacgaattgctgcggcagggcaatcctgtcctggggcgccccctcaacaaccttctcgccgccctcgcccgcgcgccggcgtccagcgcctgcagagatggccccgcactcgcggtcgccctcttcagccgcatatcccaaggcgcccgcctaagggtgctgcacccaacggcctgcacctacggcatcctcatggactgctgctgccgcgcgaaccgccaggatctggcgctcgccttcttcggccgtctcctcaggacgggactgaaggcaggcgtcatagaagtcaacactcttctcaagggactctgccgcgcaaagcgggctgatgaggctctggacattctgcttcacaggatgcctgagcttggctgcacccctgacgtggtggcg

SEQ ID NO: 3090 - DNA, 555 bp, Triticum aestivum
atgtcgccactgcgcctccgcctccgcctgcacgcccgccactcctcctccgcctcgcaaccctcacgccgccagggatgggatccccacgccgccttcgccgccgccacggagtgtgcgcgctccggcaacctcaccccggaggacgcacaccacctgttcaacgaattgctgcggcagggcaatcctgtcctggggcgccccctcaacaaccttctcgccgccctcgcccgcgcgccggcgtccagcgcctgcagagatggccccgcactcgcggtcgccctcttcagccgcatatcccaaggcgcccgcctaagggtgctgcacccaacggcctgcacctacggcatcctcatggactgctgctgccgcgcgaaccgccaggatctggcgctcgccttcttcggccgtctcctcaggacgggactgaaggcaggcgtcatagaagtcaacactcttctcaagggactctgccgcgcaaagcgggctgatgaggctctggacattctgcttcacaggatgcctgagcttggctgcacccctgacgtggtggcg

SEQ ID NO: 3091 - DNA, 555 bp, Triticum aestivum; identical to SEQ ID NO: 3090

SEQ ID NO: 3092 - DNA, 555 bp, Triticum aestivum; identical to SEQ ID NO: 3089

SEQ ID NO: 3093 - DNA, 606 bp, Triticum aestivum
atgcctcgcttctcctccagcacgccaatgtcgccagcacgtctccgcctcctccgactctgcgcccgccactcctcctccacctctcatccctcacgcatctgggatccccacgccgccttcgccgccgcgacgcagcgggcgcgctctggcacgctcaccacggaggacgcacaccacctgttcgacgaattgctgcggcagggcaatcacgtccaggagcgtcccttgaataactttctggctgcccttgcccgcgcgcccgcgtccccattctgtagcgatggccccgccctggcggtcgccctcttcggccgtttgtcccgaggcgccggacgacgggtggcgcagccaaatgtcttcacctatggcgtcctaatggactgctgctgccgtgcgcgccgcctggatctagcgatcgccttcttcgcccgtctcctcaagacgggactggaggcaggccaagtcgttttcggcaccctcctcaagggactctgccatgcaaagcgctcagatgaggctctggacgtgctgcttcacaggatgcctgagctgggctgcatccctacaaagtatcagtttctggaagaagcagccacagttgaa

SEQ ID NO: 3094 - DNA, 606 bp, Triticum aestivum; identical to SEQ ID NO: 3093

SEQ ID NO: 3095 - DNA, 618 bp, Triticum aestivum
atgactgatctctgtgagctgatggcaagagacggtattgtaccctatctccattgtttcagcatattgattaatgcatatgctaagtgtggaatgatagatgtggctatacttttcttcaaagacatgttgaagcagggagtgaaccctgatgaagtcacatatttagctgtgatagccgggtattgcagagtgggcatgatggatgatgctatggaaaaattcaatgagatgattgatatgggagtaccacataacgcaactgtttacaggtgtatgattcagggttacttaaatcatggtgatttcttgaaagcaaaggaattgattactgaaatgaagaccaagggtatccatcctagatgcggaaaagccaaagaattgatccagggcagtagcggatcagtggacaacattccagtggctaggggtctacactacaccaaaattagtatgatggacaaacattgcactagtaaaactaaaactagtaaattgtttgtgggggccatgacccccatgaccccacccctagatccgccactgacccagggtacctcatgtcacaactcttttacaggtgcatgttccagggttgttttcatcatggtaattaca

SEQ ID NO: 3096 - DNA, 618 bp, Triticum aestivum; identical to SEQ ID NO: 3095

SEQ ID NO: 3097 - DNA, 618 bp, Triticum aestivum; identical to SEQ ID NO: 3095

SEQ ID NO: 3098 - DNA, 618 bp, Triticum aestivum; identical to SEQ ID NO: 3095

SEQ ID NO: 3099 - DNA, 618 bp, Triticum aestivum; identical to SEQ ID NO: 3095

SEQ ID NO: 3100 - DNA, 618 bp, Triticum aestivum; identical to SEQ ID NO: 3095

SEQ ID NO: 3101 - DNA, 561 bp, Triticum aestivum
atgttggatcgcagcatctgtcccgacagagtgttcttcaacactgatatggatcacctttgcaaaagtggaagggttatggaagcccaggatatcttcgacctgatggtacacatgggtgtgaagccttttgtccgtgattacaacacactgatacatggatactgtttagttggtaagatggatgaagggaggaagttacttgacaatatgtgctcaattggcttgaaaccggatgatttcacctatagcatactgattgatggttactctatgaagggaaggatagatgatgcattgattgttgtcagggaaatgttagacgggaaggttaaaccttctattatcactattaatattatgattggtgcattgcttaaaggtggcagaaaggaagaagccaaagatttgtttgatggtatctgggccaaaggattagtgcccaatgttgttacatatagcttaatgatacaaaaacttatagaagaaggttctctacaagagtctgatgatctattccttctatggagaagaatggatgtgctgccaactcccgtacac

SEQ ID NO: 3102 - DNA, 561 bp, Triticum aestivum; identical to SEQ ID NO: 3101

SEQ ID NO: 3103 - DNA, 483 bp, Triticum aestivum
atgttccaggaattaggtgcaatgaatgtgaagttcgatattataacactcaataccatgattaatgccatgtacaaggttcagagaagagaagaagctaaaggtttgtttgctgcaatatcagccagtgggttggtgcctgatgcttatacttacaacgtaatgataaacaatcttctaaaagaaggatcagtggaagaagttgacaatatgttttcattgatggagaagagtggttgtgctcccagctctcatcttgtaaatgatatcaccagaaggttgttgggaaaaggtgagattgccaaggctggaaattatttgtctaaagttgatgggaagatcatctcacttgaagattcaaccacttcattgttgtcgtctcttttttcaagcaaagggaaatatcgggagaacatcaagttacttcctgcaaattatcacgttttagatggatttagtcgcattgcacatgagaataactcc

SEQ ID NO: 3104 - DNA, 483 bp, Triticum aestivum; identical to SEQ ID NO: 3103

SEQ ID NO: 3105 - DNA, 633 bp, Triticum aestivum
atgataatggtatttcaccagatcattatggctacaacatactcatatctgcttatgctaaagaaaaaaatggttgatgatgtattgcatatatttacaaaaatgcggcagcaaggattgaaccctgatgttgcgaactatggagcggtaataaacttgctttctagtattggccgaatggatgatgctatgtcccaatacaatcaaatgataaatgaagggttagctcctgatatcatagttttcaactcccttattagtggtttctattcttgtggcaaatgggagaaggttcatgaactattttctgagatgttggatcgcggcatctgtcccaacacagtgttcttgaacacaattatggaccgcctttgcaaaaatgaaagggttatggaagcccaagatctcttcgacctgatggtacacatgggtgtgaagcctgatgtgtgtacttatagcacactgataggtggatacttgttcgttggtaagatggatgaagtgagcaagttacttgacaatatggtctcaattggcatggaaccagatgttatcacctataacatactgatgcacctcatatacctcatatatatccatcttgtctgttatgtcccatggacatatctcatt

SEQ ID NO: 3106 - DNA, 474 bp, Triticum aestivum
atggttgataatggtgttagaccggacaacgtgacatataatagcctcatccatggatattcctcttcaggccactggaaggacatggttaggttattcaaggaaatgaaaaatcggagtgttacaccagatgtgtgtacttacaacttgttgatgaactcccttcgcaagaatggaaaaaccaaagacgctgcagaaaattttgattcaatggcaatgaagggcctgaaacctgacaccatttcatatgctattatccttcatgggtatgccaccgaaggatgtttagttgatatgattaatctcttcaattcaatggcaacagactgtattctacctgactgtgatatcttcaacatactgattgatgcatatgctaaatctgggaagcttgataaggctatgcttatgtttaaagagatgcagaaacaaggagtgagtccagaactccagatgcagtcacatattcaaccg

SEQ ID NO: 3107 - DNA, 589 bp, Triticum aestivum
atgagatacacagtgagttcattcatccaactcgcgcgccaactgttcgacgaaatgctgcgccaaccagtcccaatatcggcgcgtgcactcaacggcttatttgctgcacttgcgcgtgcgccgccttcaaccgcctgcactgatggccctgcgctcgccgtcgatctcttcaaccatatggcccgagcaggccgccgctggatgacaggacccaccgtccacacttacaacatactaattgactgctgccaccgagcatgccgcccagacctagggcctgccttctttggctgcctcctcaagacaggcatcataatgagcgccattacctacagcagcctattcaagtgcctctgtgacatgaggcgcacaaaggaggctctgaacgtgctgctccataggatgcccgataacctgcctaatgtcatctcctactcagtgattctcaagagtttttgcgacagtgggaggagccagcttgcgcttgacctgctccgggtgatggccaaaaaaggtggtgaccactctcccgacgtgatggcatacaacatggtaagcaaagcatgcgatctattccacgaaatga

SEQ ID NO: 3108 - DNA, 978 bp, Triticum aestivum
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaag

SEQ ID NO: 3109 - DNA, 1014 bp, Triticum aestivum
gtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcag

SEQ ID NO: 3110 - DNA, 450 bp, Triticum aestivum
gcatccatggacgtggattgaattgaaggtgtactactgctgtgctggtccgtggatcgtggctgtcatgcatggtttgctgtgtcttctacgatatgtacttccctttgttccgtatatgtacatcttcctcgtttggttcatgtattttcctttgaataataataaataaatcgggctttccatatcggatgcttttatatctgtgtgtatggagattgtggtatatggtttcatctcaagttgtttacgtcaagaactaaagatatttcctcaaaaaaaaagaactaaagatataatcaatgtcattaacataactcatttccatgaggagaggacgaaggacgaagtcataataagtagattggttgatattttataatcattcaaaactgcaggggttataagatcttcattttgtagaagttttagatcttccgaggggttctc

SEQ ID NO: 3111 - DNA, 864 bp, Triticum aestivum
tgatgcaccggactagacagataaacattggcatggtttggagctctctctcaatgatgtcgacatgagttctgttccatgtgctcacaagatcgagctgagtgttcgtgttaccatagcgttttggcccgatgcatgcggctgctgggcgtgcatcctatggacatcgcccctaatctgcatgccatttccatgctcaaggttcgcatcctctcttcctcttaataatatgccagggctgttactaccccagggccttttcctctttattctccttttactttttgaggtcttcatgtttatagttagatgcctgtcattatacaccagaaaaactgtaagagttcctgaactagataccgtcataccgaacaagataacaacattaaacattcttaatacattttcttggtgcagatgtttatgtgatgacgtatgatcttaatctggaaagatctcttgtaggcatgccttgatgttgtttttccttatgttcgctagagggagcaatgtggccatccagttggcgaatttcacgttttcttctccactgatagcacaacctaagttgcacttgttatgaagatctttaattcattccatatgaatttgtcgcatatgttgttcctttttatgaattatatttatttggaattcgatcaagtaccgtagaatgtcgcccatctttggacagataactgttgacgtctcgaattttgcatttgtgtctccaagcactcttattttatcttccttgggcaaagttcttgttacattatgcacttgtgtcatccaagcactctcattttatcttccttgggaaaagttcttgctacattatgcacttgtgtcatccaagcagtc

SEQ ID NO: 3112 - DNA, 1000 bp, Triticum aestivum
tgcaaagagctactcacttgaagctaaaactgtttcgctgctgatctccctcttttcagggaaagggaagtatagagaacacataaaattgctccctatgaagtatcagtttctcgaagaagcagccacagttgaatagtttgatacatgatctctgaactcaactcctagaagttaacttggattgttgcttgccatgggtccttatgcttgtacaacaaatgcattttctgtttggtaaatagaaagccagtcctaaattctgtcactttttgttaagttcgtgatgcgctgaaataactatttttttccgttagttattgtgagtagtatctgaaatttcctatatttttgtttctcaggcttatcacaatctcagtattatagtttctgcagttagtgaaagaagatctatttctagtaacatgaaagcttccataaggcttgtgttccacttctcacttgctgttttgaggctgcttgcatacattttggtcgtttctttgccacttggtaagtataattgcaactgcataatactttttctatattgtacaattcacattcagttactggaaaacttgtgccccttgtgaggattctgagtgtctttgcttcactgcttcagatatatgatatcgtcaaatattggtaaagttttgggcacttggagatgccggacttcatcattgtcaaggcttctatctgaaaattggactactgcatccgcgaggatcctgcgggcactgactgtgctcttgatagaatgctggcaacggcatggttggccgcacagagaaggagtctacctgatgaaatgcagagagcaagactatgtccaattcagaggtgttgtgcatcaaattgattttaaatgaatacacgtgctcaggtcgaaggtgaagctgggatggcactatgttttgtcatgaaaaggtgttaaggctgaaaagggaatccattgactatgtttcattgagctctgaaggtcataaggatt

SEQ ID NO: 3113 - DNA, 2500 bp, Triticum aestivum
ggtggcggcccccctttcctgcctttggtcattcgtctccgcgcaggtcggctgctctggccggcccttggtggttgctgtagtgctgcggcaagggggtgccagatccatcggttcttcattcggatccagctcgtctcttgccttactcagggtcggtcaccccgtgaccttgcctgcggcagtgagggggtgtgcgtgctctgtgatgggccttgtgaggcgatggcgcgcttgctgcgcaggggtgtgcgggccaacttgtgtcggctgcgtgagggtgttggttgagtctgctccaagcgcaagcttgcccggctatggccggccggtggtggcggcgcctacgggtgtcgtttcccttgttgaaggcgttgttgtggagttcttcgacctactacaatctcgaatctggttcttcgggcgaaagccttgccccatctgggtcgggcaacgacgtcgtccgtacgatgttttccccctttggggcgttgctttgaaggccggttaacctttcccgtgctacctttgggttggtcgtgcatggtgtcatggttggctggtgctcaaccggtgatgcgagtggttggcgttgcgactcgtgcggcgacgaagatggtgatgtgcagagctgggtcgcggcttgtccttctgatgtcggcggttcgattcccctttgggtgcatctgtgcttgtttctcactatgacagagaagttgaagctgcatgcagcggggcccttgcagcaatgatgactccatgagggtggtttcggcagacggtgctctccgtaggttgcactggactagcttggtgcgaggcttgcaactttctcctgtgatgctcatcaacaaaatcggagctgtcggtcctcgacgcctgcggccgatcatttggcttggctgtcgaggtcatcgggtgtcgtttgttcagaggggtcttgatgggtcgtcagcgaggaaaccagagttgcctgctcgcggagaggcgatgacgatgacattgcttgcagcctcgacggtgtcctctcctcagcggtatgtgtgtggtcttgtcagtgccaggtcggccggagcgtcctattcgatgggcgtgttttaattaaccgagcaactctcttcttcttaatcaatgaaaatggcaagtcttttacctcgtttcaaaaagagttagatgcactggaggtatcgagatgtcagtttagtcctatgtcttccaaaatgcgcctttaggtcctaattctttcttaattggttcacccgaggtccttttccacgaccactcgctgaccagcccacgtgccgcattgacccacgccacgtcgacagagggtccaaccgccaggcgagaagcttcgcaaagagacaccccccctcttagtggcacccctctcctctttcacggtactttggcgacattggaggcgagtggcagaggcaaccggaggtgatctggaggcaatctgagtgggtgcccgtgaagatgccccttctatgacggccagtgagcggtcctcctccatgttaccgtgagaaccctaatcttgtcgatgctcttctcctgtagctcttctattatgccataactctgccataatcaatagttgtagtccttgatttacttcgatttgcataacggtgctacggacacggcaaaaaagacacaccaccagcggcaacatactcgccgaagttggagcttgcttcgccgcgccggtggcggtgctgacgatgctgccatgctcctcatcttcagttgtttccttgccgaggagcttgaagttccggccatggataggtttagggcacacgagagagcagatttggggaagaaataaagccagggactggggaatgagaaggtaatgttcataaggggttttctgtaaaaagaaagagcaacctaagcggcccctttgtcgacttggcgtgggtcaatgcgccacataggcaggtcaatgagcgcttgtgagaaaaaggtcctcgggtaaaccacttgcttaaagaattactccctccgtcctataatataagaacgtttttgacactcactagtgtagtgtcaaaaacgtttttatattatgggacggagggagtagtacctaaaggtgcattttggactaaataagactaaagtgacaccccgacgaaacttttaggacctcgagtgcatttaactcttaaaaaaacaaagatgctaaaaaaactaaatgcttaaaaatatatttttctatgggaatacttaaaaatactattataattttatggcttcctagtatatttctagggcttacaactaaatttatattcttggtctaaataaaattataatctgataaattatgtgatatgaatatgtcatatagccatatgagaccataatttaattttacctgcaaaaaataagtaatagtagtagtactactagataagataacttggtaaagcactagccccgtcgtctcccagttcaggatctacctacactgcacaccaaggcc

SEQ ID NO: 3114 - DNA, 2178 bp, Triticum aestivum
gtaggatgtgtgcggggtgattggaagatccaactataaatattattgatactctcttaaaagatgggatggtgatcaccttgcaataaagagttattttttcgcgaatagcaataaagagttatttgatggcaaaaaaaaatcagatgatgtgggctggcctaggatatatagatatataacacttccccttttatattagaatacttaaacatttcgtacattgcatgttgttatatagcctgcaaaaaaggctttcgcgctgctttatataaaaagcaacatagtcaaactgatgtatggtgatgagaagatcgtcttataaaacagatcatatggaaaaacaagaaaacaatagagtgcacaccctatcacaaaacaatctagactacaactagggggagacttgcaccaagggaaaacgcatgacctcgttgcgcaactcgtaccaaggtgacaccagagagagcccctaccctcccgctcctgatcgtggagcctaagcctgcttgcggacaacaaggatcgcgatggatgccaataagggctcgtgtaaaaagataaggaggaaaaacgacagcccacgcgcgaagccaaggaaacttcgatccagcatccgaacatgcctgccaattggcgacacggtgcaccgaaggtaacctaggccccatgacgacgcccacaggagggagacgacgtaaggagtcgccatcgtcaaaaccgaagagacaatcaagggttttcatccggagccctggctccaagagagggaccacatcgacggccccaagagagatgcgacacccatgtgcatcactgccactagtgtcgaagcacaaggctttcgcctagagcctcttacaggcgtcacatcgaggaaccccgagcatcagcccacccgagggaagagatatcactaccaaacaaggcctccatggttctgggagccgtcactgccgaggcaccaccgacaccgggatcaccaagcgtggcatcctttgccatccacacaaccaaaagatgtccccaccaccgctgccaaggcgcctgctgaaaagccgctctgacggtccgccaccctaggccgccgctccggcgtccaatatcccaacctcgactccacacgcgggcaccaacccccgaaaaccgcactcaccggtggtgacacggaaagcgaaactactccatgcacgacgttcagtgaacgatctctggacgacaaggaatcaaatggctggagctgtactttgtctattcatgatcggtgtgatcaatagcgtcgtccacagatcgggcaaaggccgtcgtccgcataacatcgctccatggaaaggctcttcctttccagtcccacggcacaccacgccgacaccagcaccatctgcggcggtgaccactgaccagcgaacctaactcggtcaaggagaccaaacctggctgggagcacgctaccccatctgcctccaccccacagcacgagcacgggtgtccattcaggtacaacaggggatccacatcagaacatctccaacaatttgtatgttagtttgttggtaaaatatgccatgtcatcaaccaacaccgtaacatacaacaacttcaatggattatatctagcctgcccaatagaatgtgagataataaataaggtgctctctcattctacattggagcttgtgcaaggagtgttgattcatgtacatacaaccttcttctctttcttcatttattgtatgacacatcatcaaaaattctactacaccctttccgatttataaggcatgcacgtatccctaggtttataatttgagcaatataaaataagttgtatattctaaaaattacaccattagaaagtagaaaatctgaaatttttaataatatattttttgtgacaaatagcttgttttacgttggtttatttgtcaacctagatatacgtgcaagccctataaatcggaaaggaggtagtatgtgacaaagtctaccaagaaatatcttataactattgagatgcccttagcgagagctggctgccgattgactgatgaatgaacaaaaatcctatatgacaaagtctaccaagaactattttataactattgccgattgactgatgaatgaaccgttaccgtcttcttgtacagaagtaaacacttgtatacctccaccgccccg

SEQ ID NO: 3115 - DNA, 2472 bp, Triticum aestivum
atgtccaggctccgctccgccagcaccgccccaatgccacgcctgaggctcctgagctgcaggagctactccatcagcaccctgccaccaagcaggtcctggagcccacacgccgccttcgccgccgccaccgagagggtgagcgccggcaccctcaccccagaggacgcccaccacctcttcgacgagctcctgcgccaaagcaccccagtgccagccaggagcctaaacggcttcctcaccgccctggccagggccagggacaccgacgcctgcagggacggcccagccctggccctcgccctgtttaacaggaccaggcgcgaggaagccggctcaagggtcgtgagcccaaccatctttacctacggcatccttatgaactgctgctgccacaccctccgcccagacctgggcctcgccttcttcggcagggtcctcaggatgggcctcaagaccaacgtcgtggtcgccaccaccgtgctgaagtgcctatgcggcgccaagaggaccgacgaggccgtcaacatcctcctgcataggatgtccgagctgggctgcgtcccagacgacttcagctactcaatcgtgctcaagtccctgtgcgacgacggccgctcccaaagggccctggacctcctccaaatgtgggagaaggagaggggcgtctgctccccaaacgtcgtggcctacaacatcgtgatccacggcttcttcaaggaaggcgaggtctccaaggcctgcgacctgttccacgccatggtgcaaaggggcgtcgtgcctaacgtcatgacctacaccctcaccatcgacgccctctgcaaggccagggccatggacaaggccaagctgttcctcaggcagatgatcgacaagggcgtgaggccaaacaacgtgacctacaacgtgatgatccacggctactccaccctgggccagtggaaggaagccggcaaggtgttccgcgagatgagccgccagggcctgatccctgacatcgtgacctggacctccttcatggccagcctctgcaagcacggcaggaccaaggaagccgccaacttcttcgacagcatgaccgccaagggccacaagccagacctggtcacctaccacgtgctcctgcacggctacggcaccgagggctgcttcgccgacatgatcaacctcgtgaacagcatggccaccaagggcatcgtgccagataggcaggtcttcaacatcctgatcgacgcccacgccaagcacggcatgatggacgaggccatgcacatcttcaccggcatgcaaggccagggcgtctgcccagacgtgtggacctactccaccatcatcagcgccctctgccgcatgggcaggctggccgacggcatggacaacttctcccaaatgatcggcaagggcgtggagcctaacaccgtcgtgtaccactccctcatccaaggcttcagcacccacggcgacctccgcaaggccaaggagctggtgtacgagatgaggaacaagggcatcccatgcccaaacatcgccttcttcacctccatcatggacagcctgtgcaaggaaggccgcgtcatggacgcccacgacatcttcaacctcgtgaccgacatcggcgagaagccaaacgtcatcacctttaacaccctcatcgacggccactgcctggtgggcgagatggagaaagccttcggcgtgctcgacagcatggtctccgccggcatcgaggccgacgtcttcacctacaacaccctggcctacggctactgccgctgcggcaggatcgacgacggcctaatcctgttcagggagatgctccgcaagaagccaaagccaaccaccatcacctacaacatcatcctggacggcctcttcagggccggcaggaccgtggccgccaagaaaatgttccacgagatgatcgagggcggcatcaccgtgtccatgagcacctactccatcatcctcggcggcctgtgcaggaacaactgcgccgaggaagccatcaccctgttccaaaagctgggcgccatgaacgtgaagctggacatcaggatcctcaacaccatgatcaacgccatgttcaaggtccgcaggcgcgaggaagccaacagcctgttcgccgccatcagcgcctccggcatggccccaaacgcctccacctacggcctcatgatcggcaacctgctcaaggaaggctccgtccaagaggccgagaatatgttctccctcatggagaagtccggctgcgccccaggcagcaggctcatcaacaacatcatccgcatcctcctggagaagggcgacatcgtgaaggccggcaactacatgtccaaggtggacggcaagaccatctccctggaggcctccaccaccagcctgctgatgtgcctcttctccagcaagggccgctacagggagcagatcaacctgctcccaggcaactaccaattcttcaacggcgtctcctga

SEQ ID NO: 3116 - DNA, 2469 bp, Triticum aestivum; identical to SEQ ID NO: 1781

SEQ ID NO: 3117 - DNA, 2226 bp, Triticum aestivum
atgcctcgcttctccaccaccacgccaatgtcgccaccccgcctcctcctccgactcggcgcccgccactcctcctccacctctcatccctcacgcatctgggatccccacgccgccttcgccgctgcgacgcagcgggcgcgctctggcacgctcaccacggaggacgcacaccacctgtttgatgaattgctgcggcagggcaatcctgtccaggagcgtcccttgactaactttctggctgccctcgcccgcgcgcccgcgtccgcattctgcagcgatggccctgccctggccgtcgccctcttcggccgtttgtcccgaggcgccggacgacgggtggcgcagccaaatgtcttcacctatggcgtcctcatggactgctgctgccgtgcgcgccgcctggatctagcgatcgccttcttcgcccgtctcctcaagacgggactggaggcaaaccaagtcatcttctgcaccctcctcaagggactctgccacgcaaagcgctcagatgaggctttggacgtggtgcttcacaggatgcctgagctaggctgcacccccaacgtggtggcctataccacggtcatccacggcttcttgaaggaaggccaagtaggcaaggcatgcaatctattccatggaatggcgcagcagggcgttgcgcctgatgtggtgacatataactcggttatcgatgcgttgtgcaaggccagagcaatggacaaggcagagtatttcctttgtgaaatggttgataatggtgtcgtacctaataatgtgacatataatagcctcatccatggatattcctctttgggccatcagaaggaggctgttagggtgctgaaagaaatgacaagacagggtatcataccagatgtcattacctgcacctcactcatgaccttcctttgcaagaatggaaaaagcaaggaagctgcagaaatttttgattcaatgcccacgaagggcctgaaacatgacgccgtttcatatgctattctccttcatgggtatgccactgaaggatgcttggttgatatgattaatctcttcaattcgatggacagagactgtattctacctaactgtcatatcttcaacatactgatttatgcatatgctaaatctgggaagcttgataaggctatgcttatatttagagatatgcagaaacaaggagtgagtccagatgcagtcacatattcaaccgtaatacatgcattttgcaaaaagggtaggttggatgatgctgtgataaagtttaatcagatgattgatacaggagtacgaccggaagcatctgcttatcgttccctaatccagggtttttgtacacatggcgatttggtgaaagcaaaggaatatgttactgaaatgatgaagaaaggtatgcttcctcctgatattatgttcttcagttcaatcatgcagaaactatgcacagaaggaagggtaatagaagcacgagatatccttgacttgatagtgcgcattggtatgaggcctaatgttttcatatttaatatactgatcggtgggtactgcctagtctgcaagatggaggatgcaacaaaaatgtttgaggatatggtgtcatttggtttagaaccttgtaatattacgtatggtatacttattaatggctattgcaaaaatagaaggattgatgatgggcttattctgttccaagagatgctgcacaagggacttaaacctacaacttttaattataatgtcatactggatgggttatttctggctggacgaactgttgctgcaaaggaaaagtttgatgagatggttgaatctggagtaagtgtgtgcagtgatacatattcgatagttcttgctggactttgcagaaataattgctctagcgaagtaatcatgctgttccagaaattaagggcaatgaacatgaaattcaatattagaattgtcactatcatgattgatgccttctacaaggttcggcgaaaccaagaagctaaggatttgtttgctgcaataccatccaatggcttggtagctaatgttgttacctacagcataatgatgaaaagtcttataaaagaaggttcagtggaagaagctgacactctttttatcgatggagaagagcggctgtactgcaaactcttggatgttaaatcatattatcagaaggttactggaaagaggagagatagtcaaggctggaaattatatgtcgaaagttga

SEQ ID NO: 3118 - DNA, 2379 bp, Triticum aestivum
atgcctcgcttctcctccagcacgccaatgtcgccaccacgcctccgcctcctcctcctcctccgacttggcgcccgccactcctcctccacctctcatccctcacgcatctgggatccccacgccgccttcgccgccgcgacgcagcgggctcgctctggcacgctcaccacggaggacgcacaccacctgttcgaagaattgctgcggcagggcaatcctgtccaggagcgtcccttgactaactttctggctgcccttgcccgcgcgcccgcgtccccattctgcagcgatggccccgccctggccgtcgccctcttcagccgtttgtcccgaggcgccggacgacgggtggcacagccaaatgttttcacctatggagtcctaatggactgctgctgccgtgcgcgccgcttggatctagcgatcgccttcttcgcccatctcctcaagacgggactggaggcaggccaagtcgttttcggcaccctcctcaagggactctgccacgcaaagcactcagatgaggctttggacgtggtgcttcacaggatgcctgagctaggctgcacccccgacgtggtggcctataccacggtcatccacggcttcttgaaggaaggccaagtaggcaaggcatgcaatctattccatggaatggcgcagcagggcgttgcgcctgatgtggtgacatatagctcagttattgatgcgctgtgcaaggccagagcaattgacaaggcagagtatttccttcgtgaaatggttgataatggtgtcgtacctaataatgtgacatataatagcctcatccatggatattcctctttgggccatcagaaggaggctgttagggtgctgaaagaaatgacaagacagggtatcatacctgatgtttttacttgcaactcggtcatggcctccctttgcaagaacggaaaaagcaaagaagctgcaaaaatgtttgattcaatgtccatgaagggcctgaaacctaacaccgtttcatatgttattctccttcatgggtatgccactgaaggatgcctagttgacatgatcaatctcttcaattccatggcaacagactgtattctacctaactgtcatatattcaacatactgatttatgcatatgctaaatctgggaagctcgacaaggctatgcttatatttaaagaaatgcagaaacaaggagtgagtccagatgcagtcacatattcaaccgtaatacatgcattttgcaaaaagggtaggttggatgatgctgtgataaagtttaatcagatgattgatacaggagtacgaccggacgcatctgtttatcgttccctaatccagggtttttgtacacatggcgatttggtgaaagcaaaggaatatgttactgaaatgatgaagaaaggtatgcttcctcctgatattatgttcttcagttcaatcatgcagaacctatgcacagaaggaagggtaatagaagcacgagatatccttgacttgatagtgtgcattggtatgaggcctgatgttttcatatttaatatactgatcggcggatactgcctagtccgcaagatggcagatgcatcaaaaatatttgatgatatggtgtcatatggtttagaaccttgtaatattacgtatggtatacttattaatggctattgcaaaaacggaaggattgatgacgggcttattctgttcaaggagatgctgcacaagggacttaaacctacaacttttaattataacgtcatactggatggattatttctggctagacaaactgttgctgcaaaggtgaagtttcatgagatggctgaatctggagtaagtgtgtgcattgatacatactctatagttcttggtggactttgtagaaataattgcatcggtgaagcaatcacgctatttcagaaattaagtacaatgaatgttaaattcaatattgcaattgtcaatatcatgattggtgcattcttcagggttcggcgaaaccaggaagctaaggatttgtttgctgcagtatcagccaatggtttggtagctaatgtctttacctacactgtaatgatgataaatcttatagaagaagggtcactggaagaagctgacactctctttttatcaatgaagaagtccggctgtactgccaactcttgtatgttaaatcatattatcagaaggttactggaaagaggagagatagtcaaggctggaaattatatgtcgaaagttgatgcaaagagctactcacttgaagctaaaactgttttgctgctgatctctctcttttcagggaatgggaaatatagagaacacataaaattgctccctatgaagtatcagtttctcgaagaagcagccacagttgaatag

SEQ ID NO: 3119 - DNA, 2379 bp, Triticum aestivum
atgcctcgcttctcctccaccacgccaatgtcgccaccccgcctcctcctccggctcggcgcccgccactcctcctccacctctcatccctcacgcatctgggatccccacgccgccttcgccgctgcgacgcagcgggcgcgctctggcacgctcaccacggaggacgcacaccacctgtttgatgaattgctgcggcagggcaatcctgtccaggagcgtcccttgactaactttctggctgccctcgcccgcgcgcccgcgtccgcattctgcagcgatggccctgccctggccgtcgccctcttcggccgtttgtcccgaggcgccggacgacgggtggcgcagccaaatgtcttcacctatggcgtcctcatggactgctgctgccgtgcgcgccgcctggatctagcgatcgccttcttcgcccgtctcctcaagacgggactggaggcaaaccaagtcatcttctgcaccctcctcaagggactctgccacgcaaagcgctcagatgaggctttggacgtggtgcttcacaggatgcctgagctaggctgcacccccaacgtggtggcctataccacggtcatccacggcttcttgaaggaaggccaagtaggcaaggcatgcaatctattccatggaatggcgcagcagggcgttgcgcctgatgtggtgacatataactcggttatcgatgcgttgtgcaaggccagagcaatggacaaggcagagtatttccttcgtgaaatggttgataatggtgtcgtacctaataatgtgacatataatagcctcatccatggatattcctctttgggccatcagaaggaggctgttagggtgctgaaagaaatgacaagacagggtatcataccagatgtcattacctgcacctcactcatgaccttcctttgcaagaatggaaaaagcaaggaagctgcagaaatttttgattcaatggccacgaagggcctgaaacatgacgccgtttcatatgctattctccttcatgggtatgccactgaaggatgcttggttgatatgattaatctcttcaattcgatggacagagactgtattctacctaactgtcatatcttcaacatactgatttatgcatatgctaaatctgggaagcttgataaggctatgcttatatttagagatatgcagaaacaaggagtgagcccagatgcattcacatattcaaccttaatacatgcattttgtaaaaagggtcggttggacgatgctatgataaagtttaatcagatggttgatacaggagtacgacagggcacagctgtttatggttctctaatccagggtttttgtacacacggcgatttggtgaaaggaaaggaattggttactgaaatgatgaacaaaggtatacctcctcctgacattatgttcttccattcaatcatgcagaacctatgcacagaaggaagggtagtagaagcacgggatatccttggcttgatagcacacataggtatgaggcctaatgtttgcacatttaatatactgattggtggatactgcctagtccgcaagatggaggatgcctcaaaaatatttcatgatatgatgtcatatggtttagaaccttctaatgttacgtatggtattcttattaatggctattgcaaaaacagaaggattgatgacgggctgattctgttcaaagaaatgttgcgcaagggacttaaacctacaacttttaattacaacatcatactggatggattatttctggctggacgaactgttgctgcaaaggaaaagtttgatgagatggttgaatctggagtaagtatgtgcatcagtacttactctatagttcttcgtggactttgtagaaataattgtagcggcgaagccatcacgctattccagacattaagcgcaatggatgtgaaattcaatattagaattgtcaatatcatgattgatgccttcttcagggttcagcgaaagcaagaagctaaggatttgtttgctgcaataacagccaatgggttggttgctaatgtttttacctacagcctaatgatgacaaatcttataaaagaagggtcagtggaagaggctgacacactctttttatcgatggagatgagcggctgtacttcgaactcgtggatgttaaatcttattatcagagggttgctggaaaaaggagagatagtcaaggctggatgttatatgtctaaagttgatgccaagagctactcacttgaagctaaaactgtttcgttgctgatctatctcttttcagggaaagggaaatacagagaacacataagattgctacctacaaagtatcagtttctcgaagaagcagccacagttgaatggtttgctatatag

SEQ ID NO: 3120 - DNA, 2358 bp, Triticum aestivum
atgtcgccactccgcctccgcctccgcctccggccccgcctccatgcccgccactcctactccacctcgcatcccccacgcggccagggctgggatccccacgcctccttcgcagctgccacggagcgcgcgcgatctggcaacctctcctcggaggacgcacaccacctgttcgaccaattgctcctgcaggctaatccggtcaacatgcgccttccgaacgaccttctcaccgccctggctcgcgcacctgcgtccgcatcctgcagcaacggccccgccctcgccgtcgccctcttcagccgtttgtcccaaggtgcccgccaacgggtggtgcagccaacggcctgcacctacggcatcctcatggactgctgctgccgcgcaaaccgccaggatctggcgctcgccttcttcgcccgtctcctcaggacgggactcaaggcaggcgtcatagaagtcaacactcttctcaagggactctgccgtgcaaagcgggctgatgaggctctggacattctgcttcacaggatgcctgagctaggctgcacccccaacgtggtggcatataacacggtcatccatggcttcttccaagaaggccaagcaggcaaggcgtgcagcttgttccatgaaatggcgcagcagggcgttgcgcctagtttggtgacatataactcggttattgatgcgctgtgcaaggccagagccatggacaaggcagagtatttccttggtcagatggttgatgatggtgtcatacctgataatgtgacatataatagcctcatccatggatattcctcttcaggccactggaaggaggcagttagggtattcaaagagatgacaagtcggagggttaaaccaaatgtgcatactcacaacatgtttatgacctttctttgcaaacatggaagaagcaaagaagctgcaggaatttttgataccatggctatgaagggcctgaaacataacaacgtttcatatgctattctccttcacgggtatgccaccgaaggatgcttagttgatatgattaatctcttcaattcaatggaaagatactgcattctacctgactgtcgtatcttcaacatactgattcatgcacatgctaaatctgggaagcttgataaggccatgcttatcttcaatgaaatgcagaaacaaggagtgagtccaaatgcagtcacatattcaaccataatacatgcattttgcaaaaagggtaggttggacgatgctgtgataaagtttaatcagatgattgatacaggagtacgacagggcacagctgtttatcgttccctaatccagggtttttgtacacacggcgattcggtgaaagcaaaggaattgctcactgaaatgatgaacaaaggtatgcttcctcctgatattgcattcttcaattcaatcatgcagaacctttgcacagaaggaagggtaatagaagcacgggatgtccttggcttgatagcgcacataggtatgaggcctgatgtttgcacatttaatatactgatcggtggatactgcctagtcggcaagatggaacatgcctcaaaaatatttgatgatatgatgtcatatggcttagaaccttctaatattacgtatggtatacttattaatggctattgcaaaaatagaaggattgatgacgggcttattctgttcaaagagatgctgcacaagggacttaaacctacaacttttaattataacgtcatactggatggattatttctggctggacgaactgttgctgcaaaggaaaagtttgatgagatggttgaatctggagtaagtgtgtgcattggtacatattcgatagttcttggtggactttgtagaaataattgtagcggcgaagcaatcacgctattccagaaattaagcacaatggatgtgaaattcaatattataattgtcaatataatgattgatgctttctacaaggttcagcgaaaccaagaagccaaggatttgtttgctgcagtatcagccaatggtttggtagctaatgtctttacctacaccataatgatgaaaaatcttataaaagaagggtcagtggaagaagctgacgatctctttttatcaatggagaagtccggctgtactgctgactcttatatgttaaatcttatcgtcagaatgttactgggaaaaggagagatagtcaaggctgggaattatatatctaaaattgatgcaaagagctactcacttgaagctaaaactgtttcgctgcttatctctctcttttcagggaaagggaaatatagagaacacataggattgctccctgcaaagtatcggtttcgtgaagaagcagctacagttgtgtag

SEQ ID NO: 3121 - DNA, 2001 bp, Triticum aestivum
atggtccgtcctgtagaaaccccaacccgtgaaatcaaaaaactcgacggcctgtgggcattcagtctggatcgcgaaaactgtggaattggtcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcaggtatcaccgtttgtgtgaacaacgaactgaactggcagactatcccgccgggaatggtgattaccgaggaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatga

SEQ ID NO: 3122 - DNA, 6069 bp, Triticum aestivum
catatttccttcactagcttggtgcgaggcttgcaactttctcctgtgatgctcatcaacaaaatcggagctgtcggtcctcgacgcctgcggccgatcgtttggcttggctgtcgaggtcatcgggtgtcgtttgttcagaggggtcttgatgggtcgtcagcgaggaaaccagagttgcctgctcgcagagaggcgatgacgatgacattgcttgcagcctcgacggtgtcctctcctcagcggtatgtgtgtggtcttgtcagtgccaggtcggccggagcgccctattcgatgggcgtgttttaattaaccgagcaactctcttcttcttaatcaatgaaaatggcaagtcttttaccttgtttcaaaaagagttagatgcactggaggtcctaaaggtttcgtcgaggtgtcagtttagtcctatgtcttccaaaatgcgcctttaggtcctaattctttcttaagtggttcacccgaggtccttttccacgaccactcgctgaccagcccacgtgccgcattgacccacgccacgtcgacagagggtccaaccgccaggcgagaagcttcgcaaagagacaccccccctcttagtggcacccctctcctctttcacggtactttggcgacattggaggcgagtggcagaggcaaccggaggtgatctggaggcaatctgagtgggtgcccgtgaagatgccccttctacgacggccagtgagcgatcctcctccatgttaccgtgagaaccctaatcttgtcgatgctcttctcctgtagctcttctaatatgccataactctgccataatcaatagttgtagtccttgatttactttgatttgcataacggtgctacggacacggcaaaaaggacacaccaccggcgacaacatacccgccgaagttggagcttgcttcgccgcgccggtggcggtgctgacgatgctgccatgctcctcatcttcagttgtttccttgccgaggagcttgaagttccggccatggataggtttagggcacacgagagagcagatttggggaagaaataaagtcagggactggggaatgagaaggtaatgttcataaggggttttctgtaaaaagaaagagcaacctaagcgacccctttgtcgacttggcgtgggtcaatgcgccacacaggcaggtcaatgagcgcttgtgagaaaaaggtcctcgggtaaaccacttgcttaaagaattactccctccgtcccatattataagaacgtttttgacactagtgtagtgtcaaaaacgttcttatattatgggacggagggagtagtacctaaaggtgcattttggactaaataagactaaagtgacacccagacgaaacttttaggacctcgagtgcatctaactcttaaaaaaacaaagatgctaaaaaaactaaatgcttaaaaatatatttttctatgggaatacttaaaaatactattataattttatggcttcctagtatatttctagggcttacaactaaatttatattcttggtctaaataaaattataatctgataaattatgtgatatgaatatgtcatataggcatatgagaccataatttaattttacctgcaaaaaataagtaatagtagtagtactactagataagataacttggtaaagcactagccccgtcgtctcccagttcaggatctacctacactgcacaccaaggccatgcctcgcttctcctccaccacgccaatgtcgccaccccgcctcctcctccggctcggcgcccgccactcctcctccacctctcatccctcacgcatctgggatccccacgccgccttcgccgctgcgacgcagcgggcgcgctctggcacgctcaccacggaggacgcacaccacctgtttgatgaattgctgcggcagggcaatcctgtccaggagcgtcccttgactaactttctggctgccctcgcccgcgcgcccgcgtccgcattctgcagcgatggccctgccctggccgtcgccctcttcggccgtttgtcccgaggcgccggacgacgggtggcgcagccaaatgtcttcacctatggcgtcctcatggactgctgctgccgtgcgcgccgcctggatctagcgatcgccttcttcgcccgtctcctcaagacgggactggaggcaaaccaagtcatcttctgcaccctcctcaagggactctgccacgcaaagcgctcagatgaggctttggacgtggtgcttcacaggatgcctgagctaggctgcacccccaacgtggtggcctataccacggtcatccacggcttcttgaaggaaggccaagtaggcaaggcatgcaatctattccatggaatggcgcagcagggcgttgcgcctgatgtggtgacatataactcggttatcgatgcgttgtgcaaggccagagcaatggacaaggcagagtatttccttcgtgaaatggttgataatggtgtcgtacctaataatgtgacatataatagcctcatccatggatattcctctttgggccatcagaaggaggctgttagggtgctgaaagaaatgacaagacagggtatcataccagatgtcattacctgcacctcactcatgaccttcctttgcaagaatggaaaaagcaaggaagctgcagaaatttttgattcaatggccacgaagggcctgaaacatgacgccgtttcatatgctattctccttcatgggtatgccactgaaggatgcttggttgatatgattaatctcttcaattcgatggacagagactgtattctacctaactgtcatatcttcaacatactgatttatgcatatgctaaatctgggaagcttgataaggctatgcttatatttagagatatgcagaaacaaggagtgagcccagatgcattcacatattcaaccttaatacatgcattttgtaaaaagggtcggttggacgatgctatgataaagtttaatcagatggttgatacaggagtacgacagggcacagctgtttatggttctctaatccagggtttttgtacacacggcgatttggtgaaaggaaaggaattggttactgaaatgatgaacaaaggtatacctcctcctgacattatgttcttccattcaatcatgcagaacctatgcacagaaggaagggtagtagaagcacgggatatccttggcttgatagcacacataggtatgaggcctaatgtttgcacatttaatatactgattggtggatactgcctagtccgcaagatggaggatgcctcaaaaatatttcatgatatgatgtcatatggtttagaaccttctaatgttacgtatggtattcttattaatggctattgcaaaaacagaaggattgatgacgggctgattctgttcaaagaaatgttgcgcaagggacttaaacctacaacttttaattacaacatcatactggatggattatttctggctggacgaactgttgctgcaaaggaaaagtttgatgagatggttgaatctggagtaagtatgtgcatcagtacttactctatagttcttcgtggactttgtagaaataattgtagcggcgaagccatcacgctattccagacattaagcgcaatggatgtgaaattcaatattagaattgtcaatatcatgattgatgccttcttcagggttcagcgaaagcaagaagctaaggatttgtttgctgcaataacagccaatgggttggttgctaatgtttttacctacagcctaatgatgacaaatcttataaaagaagggtcagtggaagaggctgacacactctttttatcgatggagatgagcggctgtacttcgaactcgtggatgttaaatcttattatcagagggttgctggaaaaaggagagatagtcaaggctggatgttatatgtctaaagttgatgcgaagagctactcacttgaagctaaaactgtttcgttgctgatctatctcttttcagggaaagggaaatacagagaacacataagattgctacctacaaagtatcagtttctcgaagaagcagccacagttgaatggtttgctatatgatatctggacgtaactcctagaagctaaacttgagttgttacttgccataggttctcctgcttttgcaacaaatgcctttcatatgtgtaaatagaaagtcagcttataagaagccgtcaggatggcagagagagaacaaatcaaacgcactccaaaacaaaagagaaacctcgccaaactgaatccaaactcaaacaggtgcatcatcaaaagtctgaagctgtactgtttgctagccaaactcctacgggagattgtcaggcggccgggcatgaagtggcaggcgtctatgcgccttcgctgctgccagcatccatggcttagcatcacacggaatcgagtcaaccaattcccagcgagtttgggcgcctccattgaagatgcaaccgtttctagccgccaaatacgcctaagggtcagagtaatcagcgagcatgccccttttgtctggttcgagaagaatttgaagaagctagcagcaacaggagcttgaccggtttgttctcatcaaagccagtttaaggttagttaattataacatggtaataaagaggtgttttgttgactgttgaggtgtaatatgttatatgccaagctcttgatgattagggtgacctgtgaagcatgcaaaagtctgaatcatatgtgcttgttagttattttggcaactttttagtcttttttccatgtacagattttatggatccatttgaagtagtatgtacattctggcattaaatatgaggtgtagaggtttacttaaggaccggtctgcaaatttttttttgatcgaggcagcaccacgttgagtttaaccctgtaacttggctcacctcgatcatgctagtgttatcgccggaaattgtattatcactgggctcagcgtttttttacattgaattaaacatactctgtggttgcagaaactgactccaaacagtgttcacagttaatatggctctgtcggtaattttcattgactgtcaacatgttccttttttgaaaagtaggctggccagttgtcgttcagtactctgtatataatgatggtaagactgacaaggatatgacggatggatttgagcttctttgccatagttcaaagtgtgcagtctgggttatgctttatattattttctttttggctttggtagtatgaacaggaagcaggcaggaacgaactgatatgtggtactatattttgttatggaatctagttgttgttgttgttatcattattattattgtcatcataatcattatcccttttctccaagaaaaagtgtgccctaaattatagatcagttcattcatctcgcctctttttttaggggccatagtctgatggattttgaagagcttctccatggttttctcttctgttccttggtgcagggcctggtggaattatgctgaactgtaacattttggtactacagaaaagttcttcttaagttggtcgctttgggggcacattacatgtttgaggtactctaatttttccttggcatgtctagaccttgaatatggtttgtattaatgcactgttattattcaaattacagatatctaattttgtggaagtttattttctgactccctagatatcctgttttagttgtactattaaaggaaaaggactaccttatatttcacccatgactttcttttaggaatcagctgtaccattttataataaattatgtacgatgaaaaatgttaacaataaaccacaccagctcaaattgtttgcgaagctgaatcttaactgatgtgaggtcatattgttcttgatcttttaaaactgtaccttgtgaataatttggcatgtctaccacattacctggttaatgccctgctgagtttagtttcataatgcatggactgtgttttatcatgttaattaaacctgtgcatttcctcaacttttatttggtatcttcagctaatgccatatgaccatccagatgaact

SEQ ID NO: 3123 - DNA, 1716 bp, Triticum aestivum
catatttccttcactagcttggtgcgaggcttgcaactttctcctgtgatgctcatcaacaaaatcggagctgtcggtcctcgacgcctgcggccgatcgtttggcttggctgtcgaggtcatcgggtgtcgtttgttcagaggggtcttgatgggtcgtcagcgaggaaaccagagttgcctgctcgcagagaggcgatgacgatgacattgcttgcagcctcgacggtgtcctctcctcagcggtatgtgtgtggtcttgtcagtgccaggtcggccggagcgccctattcgatgggcgtgttttaattaaccgagcaactctcttcttcttaatcaatgaaaatggcaagtcttttaccttgtttcaaaaagagttagatgcactggaggtcctaaaggtttcgtcgaggtgtcagtttagtcctatgtcttccaaaatgcgcctttaggtcctaattctttcttaagtggttcacccgaggtccttttccacgaccactcgctgaccagcccacgtgccgcattgacccacgccacgtcgacagagggtccaaccgccaggcgagaagcttcgcaaagagacaccccccctcttagtggcacccctctcctctttcacggtactttggcgacattggaggcgagtggcagaggcaaccggaggtgatctggaggcaatctgagtgggtgcccgtgaagatgccccttctacgacggccagtgagcgatcctcctccatgttaccgtgagaaccctaatcttgtcgatgctcttctcctgtagctcttctaatatgccataactctgccataatcaatagttgtagtccttgatttactttgatttgcataacggtgctacggacacggcaaaaaggacacaccaccggcgacaacatacccgccgaagttggagcttgcttcgccgcgccggtggcggtgctgacgatgctgccatgctcctcatcttcagttgtttccttgccgaggagcttgaagttccggccatggataggtttagggcacacgagagagcagatttggggaagaaataaagtcagggactggggaatgagaaggtaatgttcataaggggttttctgtaaaaagaaagagcaacctaagcgacccctttgtcgacttggcgtgggtcaatgcgccacacaggcaggtcaatgagcgcttgtgagaaaaaggtcctcgggtaaaccacttgcttaaagaattactccctccgtcccatattataagaacgtttttgacactagtgtagtgtcaaaaacgttcttatattatgggacggagggagtagtacctaaaggtgcattttggactaaataagactaaagtgacacccagacgaaacttttaggacctcgagtgcatctaactcttaaaaaaacaaagatgctaaaaaaactaaatgcttaaaaatatatttttctatgggaatacttaaaaatactattataattttatggcttcctagtatatttctagggcttacaactaaatttatattcttggtctaaataaaattataatctgataaattatgtgatatgaatatgtcatataggcatatgagaccataatttaattttacctgcaaaaaataagtaatagtagtagtactactagataagataacttggtaaagcactagccccgtcgtctcccagttcaggatctacctacactgcacaccaaggcc

SEQ ID NO: 3124 - DNA, 1974 bp, Triticum aestivum
tatctggacgtaactcctagaagctaaacttgagttgttacttgccataggttctcctgcttttgcaacaaatgcctttcatatgtgtaaatagaaagtcagcttataagaagccgtcaggatggcagagagagaacaaatcaaacgcactccaaaacaaaagagaaacctcgccaaactgaatccaaactcaaacaggtgcatcatcaaaagtctgaagctgtactgtttgctagccaaactcctacgggagattgtcaggcggccgggcatgaagtggcaggcgtctatgcgccttcgctgctgccagcatccatggcttagcatcacacggaatcgagtcaaccaattcccagcgagtttgggcgcctccattgaagatgcaaccgtttctagccgccaaatacgcctaagggtcagagtaatcagcgagcatgccccttttgtctggttcgagaagaatttgaagaagctagcagcaacaggagcttgaccggtttgttctcatcaaagccagtttaaggttagttaattataacatggtaataaagaggtgttttgttgactgttgaggtgtaatatgttatatgccaagctcttgatgattagggtgacctgtgaagcatgcaaaagtctgaatcatatgtgcttgttagttattttggcaactttttagtcttttttccatgtacagattttatggatccatttgaagtagtatgtacattctggcattaaatatgaggtgtagaggtttacttaaggaccggtctgcaaatttttttttgatcgaggcagcaccacgttgagtttaaccctgtaacttggctcacctcgatcatgctagtgttatcgccggaaattgtattatcactgggctcagcgtttttttacattgaattaaacatactctgtggttgcagaaactgactccaaacagtgttcacagttaatatggctctgtcggtaattttcattgactgtcaacatgttccttttttgaaaagtaggctggccagttgtcgttcagtactctgtatataatgatggtaagactgacaaggatatgacggatggatttgagcttctttgccatagttcaaagtgtgcagtctgggttatgctttatattattttctttttggctttggtagtatgaacaggaagcaggcaggaacgaactgatatgtggtactatattttgttatggaatctagttgttgttgttgttatcattattattattgtcatcataatcattatcccttttctccaagaaaaagtgtgccctaaattatagatcagttcattcatctcgcctctttttttaggggccatagtctgatggattttgaagagcttctccatggttttctcttctgttccttggtgcagggcctggtggaattatgctgaactgtaacattttggtactacagaaaagttcttcttaagttggtcgctttgggggcacattacatgtttgaggtactctaatttttccttggcatgtctagaccttgaatatggtttgtattaatgcactgttattattcaaattacagatatctaattttgtggaagtttattttctgactccctagatatcctgttttagttgtactattaaaggaaaaggactaccttatatttcacccatgactttcttttaggaatcagctgtaccattttataataaattatgtacgatgaaaaatgttaacaataaaccacaccagctcaaattgtttgcgaagctgaatcttaactgatgtgaggtcatattgttcttgatcttttaaaactgtaccttgtgaataatttggcatgtctaccacattacctggttaatgccctgctgagtttagtttcataatgcatggactgtgttttatcatgttaattaaacctgtgcatttcctcaacttttatttggtatcttcagctaatgccatatgaccatccagatgaact

SEQ ID NO: 3125 - DNA, 4926 bp, Triticum aestivum
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtctccaccatgtccaggctccgctccgccagcaccgccccaatgccacgcctgaggctcctgagctgcaggagctactccatcagcaccctgccaccaagcaggtcctggagcccacacgccgccttcgccgccgccaccgagagggtgagcgccggcaccctcaccccagaggacgcccaccacctcttcgacgagctcctgcgccaaagcaccccagtgccagccaggagcctaaacggcttcctcaccgccctggccagggccagggacaccgacgcctgcagggacggcccagccctggccctcgccctgtttaacaggaccaggcgcgaggaagccggctcaagggtcgtgagcccaaccatctttacctacggcatccttatgaactgctgctgccacaccctccgcccagacctgggcctcgccttcttcggcagggtcctcaggatgggcctcaagaccaacgtcgtggtcgccaccaccgtgctgaagtgcctatgcggcgccaagaggaccgacgaggccgtcaacatcctcctgcataggatgtccgagctgggctgcgtcccagacgacttcagctactcaatcgtgctcaagtccctgtgcgacgacggccgctcccaaagggccctggacctcctccaaatgtgggagaaggagaggggcgtctgctccccaaacgtcgtggcctacaacatcgtgatccacggcttcttcaaggaaggcgaggtctccaaggcctgcgacctgttccacgccatggtgcaaaggggcgtcgtgcctaacgtcatgacctacaccctcaccatcgacgccctctgcaaggccagggccatggacaaggccaagctgttcctcaggcagatgatcgacaagggcgtgaggccaaacaacgtgacctacaacgtgatgatccacggctactccaccctgggccagtggaaggaagccggcaaggtgttccgcgagatgagccgccagggcctgatccctgacatcgtgacctggacctccttcatggccagcctctgcaagcacggcaggaccaaggaagccgccaacttcttcgacagcatgaccgccaagggccacaagccagacctggtcacctaccacgtgctcctgcacggctacggcaccgagggctgcttcgccgacatgatcaacctcgtgaacagcatggccaccaagggcatcgtgccagataggcaggtcttcaacatcctgatcgacgcccacgccaagcacggcatgatggacgaggccatgcacatcttcaccggcatgcaaggccagggcgtctgcccagacgtgtggacctactccaccatcatcagcgccctctgccgcatgggcaggctggccgacggcatggacaacttctcccaaatgatcggcaagggcgtggagcctaacaccgtcgtgtaccactccctcatccaaggcttcagcacccacggcgacctccgcaaggccaaggagctggtgtacgagatgaggaacaagggcatcccatgcccaaacatcgccttcttcacctccatcatggacagcctgtgcaaggaaggccgcgtcatggacgcccacgacatcttcaacctcgtgaccgacatcggcgagaagccaaacgtcatcacctttaacaccctcatcgacggccactgcctggtgggcgagatggagaaagccttcggcgtgctcgacagcatggtctccgccggcatcgaggccgacgtcttcacctacaacaccctggcctacggctactgccgctgcggcaggatcgacgacggcctaatcctgttcagggagatgctccgcaagaagccaaagccaaccaccatcacctacaacatcatcctggacggcctcttcagggccggcaggaccgtggccgccaagaaaatgttccacgagatgatcgagggcggcatcaccgtgtccatgagcacctactccatcatcctcggcggcctgtgcaggaacaactgcgccgaggaagccatcaccctgttccaaaagctgggcgccatgaacgtgaagctggacatcaggatcctcaacaccatgatcaacgccatgttcaaggtccgcaggcgcgaggaagccaacagcctgttcgccgccatcagcgcctccggcatggccccaaacgcctccacctacggcctcatgatcggcaacctgctcaaggaaggctccgtccaagaggccgagaatatgttctccctcatggagaagtccggctgcgccccaggcagcaggctcatcaacaacatcatccgcatcctcctggagaagggcgacatcgtgaaggccggcaactacatgtccaaggtggacggcaagaccatctccctggaggcctccaccaccagcctgctgatgtgcctcttctccagcaagggccgctacagggagcagatcaacctgctcccaggcaactaccaattcttcaacggcgtctcctgaaacgcatccatggacgtggattgaattgaaggtgtactactgctgtgctggtccgtggatcgtggctgtcatgcatggtttgctgtgtcttctacgatatgtacttccctttgttccgtatatgtacatcttcctcgtttggttcatgtattttcctttgaataataataaataaatcgggctttccatatcggatgcttttatatctgtgtgtatggagattgtggtatatggtttcatctcaagttgtttacgtcaagaactaaagatatttcctcaaaaaaaaagaactaaagatataatcaatgtcattaacataactcatttccatgaggagaggacgaaggacgaagtcataataagtagattggttgatattttataatcattcaaaactgcaggggttataagatcttcattttgtagaagttttagatcttccgaggggttctc

SEQ ID NO: 3126 - DNA, 5726 bp, Triticum aestivum
ggtggcggcccccctttcctgcctttggtcattcgtctccgcgcaggtcggctgctctggccggcccttggtggttgctgtagtgctgcggcaagggggtgccagatccatcggttcttcattcggatccagctcgtctcttgccttactcagggtcggtcaccccgtgaccttgcctgcggcagtgagggggtgtgcgtgctctgtgatgggccttgtgaggcgatggcgcgcttgctgcgcaggggtgtgcgggccaacttgtgtcggctgcgtgagggtgttggttgagtctgctccaagcgcaagcttgcccggctatggccggccggtggtggcggcgcctacgggtgtcgtttcccttgttgaaggcgttgttgtggagttcttcgacctactacaatctcgaatctggttcttcgggcgaaagccttgccccatctgggtcgggcaacgacgtcgtccgtacgatgttttccccctttggggcgttgctttgaaggccggttaacctttcccgtgctacctttgggttggtcgtgcatggtgtcatggttggctggtgctcaaccggtgatgcgagtggttggcgttgcgactcgtgcggcgacgaagatggtgatgtgcagagctgggtcgcggcttgtccttctgatgtcggcggttcgattcccctttgggtgcatctgtgcttgtttctcactatgacagagaagttgaagctgcatgcagcggggcccttgcagcaatgatgactccatgagggtggtttcggcagacggtgctctccgtaggttgcactggactagcttggtgcgaggcttgcaactttctcctgtgatgctcatcaacaaaatcggagctgtcggtcctcgacgcctgcggccgatcatttggcttggctgtcgaggtcatcgggtgtcgtttgttcagaggggtcttgatgggtcgtcagcgaggaaaccagagttgcctgctcgcggagaggcgatgacgatgacattgcttgcagcctcgacggtgtcctctcctcagcggtatgtgtgtggtcttgtcagtgccaggtcggccggagcgtcctattcgatgggcgtgttttaattaaccgagcaactctcttcttcttaatcaatgaaaatggcaagtcttttacctcgtttcaaaaagagttagatgcactggaggtatcgagatgtcagtttagtcctatgtcttccaaaatgcgcctttaggtcctaattctttcttaattggttcacccgaggtccttttccacgaccactcgctgaccagcccacgtgccgcattgacccacgccacgtcgacagagggtccaaccgccaggcgagaagcttcgcaaagagacaccccccctcttagtggcacccctctcctctttcacggtactttggcgacattggaggcgagtggcagaggcaaccggaggtgatctggaggcaatctgagtgggtgcccgtgaagatgccccttctatgacggccagtgagcggtcctcctccatgttaccgtgagaaccctaatcttgtcgatgctcttctcctgtagctcttctattatgccataactctgccataatcaatagttgtagtccttgatttacttcgatttgcataacggtgctacggacacggcaaaaaagacacaccaccagcggcaacatactcgccgaagttggagcttgcttcgccgcgccggtggcggtgctgacgatgctgccatgctcctcatcttcagttgtttccttgccgaggagcttgaagttccggccatggataggtttagggcacacgagagagcagatttggggaagaaataaagccagggactggggaatgagaaggtaatgttcataaggggttttctgtaaaaagaaagagcaacctaagcggcccctttgtcgacttggcgtgggtcaatgcgccacataggcaggtcaatgagcgcttgtgagaaaaaggtcctcgggtaaaccacttgcttaaagaattactccctccgtcctataatataagaacgtttttgacactcactagtgtagtgtcaaaaacgtttttatattatgggacggagggagtagtacctaaaggtgcattttggactaaataagactaaagtgacaccccgacgaaacttttaggacctcgagtgcatttaactcttaaaaaaacaaagatgctaaaaaaactaaatgcttaaaaatatatttttctatgggaatacttaaaaatactattataattttatggcttcctagtatatttctagggcttacaactaaatttatattcttggtctaaataaaattataatctgataaattatgtgatatgaatatgtcatatagccatatgagaccataatttaattttacctgcaaaaaataagtaatagtagtagtactactagataagataacttggtaaagcactagccccgtcgtctcccagttcaggatctacctacactgcacaccaaggccatgcctcgcttctccaccaccacgccaatgtcgccaccccgcctcctcctccgactcggcgcccgccactcctcctccacctctcatccctcacgcatctgggatccccacgccgccttcgccgctgcgacgcagcgggcgcgctctggcacgctcaccacggaggacgcacaccacctgtttgatgaattgctgcggcagggcaatcctgtccaggagcgtcccttgactaactttctggctgccctcgcccgcgcgcccgcgtccgcattctgcagcgatggccctgccctggccgtcgccctcttcggccgtttgtcccgaggcgccggacgacgggtggcgcagccaaatgtcttcacctatggcgtcctcatggactgctgctgccgtgcgcgccgcctggatctagcgatcgccttcttcgcccgtctcctcaagacgggactggaggcaaaccaagtcatcttctgcaccctcctcaagggactctgccacgcaaagcgctcagatgaggctttggacgtggtgcttcacaggatgcctgagctaggctgcacccccaacgtggtggcctataccacggtcatccacggcttcttgaaggaaggccaagtaggcaaggcatgcaatctattccatggaatggcgcagcagggcgttgcgcctgatgtggtgacatataactcggttatcgatgcgttgtgcaaggccagagcaatggacaaggcagagtatttcctttgtgaaatggttgataatggtgtcgtacctaataatgtgacatataatagcctcatccatggatattcctctttgggccatcagaaggaggctgttagggtgctgaaagaaatgacaagacagggtatcataccagatgtcattacctgcacctcactcatgaccttcctttgcaagaatggaaaaagcaaggaagctgcagaaatttttgattcaatgcccacgaagggcctgaaacatgacgccgtttcatatgctattctccttcatgggtatgccactgaaggatgcttggttgatatgattaatctcttcaattcgatggacagagactgtattctacctaactgtcatatcttcaacatactgatttatgcatatgctaaatctgggaagcttgataaggctatgcttatatttagagatatgcagaaacaaggagtgagtccagatgcagtcacatattcaaccgtaatacatgcattttgcaaaaagggtaggttggatgatgctgtgataaagtttaatcagatgattgatacaggagtacgaccggaagcatctgcttatcgttccctaatccagggtttttgtacacatggcgatttggtgaaagcaaaggaatatgttactgaaatgatgaagaaaggtatgcttcctcctgatattatgttcttcagttcaatcatgcagaaactatgcacagaaggaagggtaatagaagcacgagatatccttgacttgatagtgcgcattggtatgaggcctaatgttttcatatttaatatactgatcggtgggtactgcctagtctgcaagatggaggatgcaacaaaaatgtttgaggatatggtgtcatttggtttagaaccttgtaatattacgtatggtatacttattaatggctattgcaaaaatagaaggattgatgatgggcttattctgttccaagagatgctgcacaagggacttaaacctacaacttttaattataatgtcatactggatgggttatttctggctggacgaactgttgctgcaaaggaaaagtttgatgagatggttgaatctggagtaagtgtgtgcagtgatacatattcgatagttcttgctggactttgcagaaataattgctctagcgaagtaatcatgctgttccagaaattaagggcaatgaacatgaaattcaatattagaattgtcactatcatgattgatgccttctacaaggttcggcgaaaccaagaagctaaggatttgtttgctgcaataccatccaatggcttggtagctaatgttgttacctacagcataatgatgaaaagtcttataaaagaaggttcagtggaagaagctgacactctttttatcgatggagaagagcggctgtactgcaaactcttggatgttaaatcatattatcagaaggttactggaaagaggagagatagtcaaggctggaaattatatgtcgaaagttgatgcaaagagctactcacttgaagctaaaactgtttcgctgctgatctccctcttttcagggaaagggaagtatagagaacacataaaattgctccctatgaagtatcagtttctcgaagaagcagccacagttgaatagtttgatacatgatctctgaactcaactcctagaagttaacttggattgttgcttgccatgggtccttatgcttgtacaacaaatgcattttctgtttggtaaatagaaagccagtcctaaattctgtcactttttgttaagttcgtgatgcgctgaaataactatttttttccgttagttattgtgagtagtatctgaaatttcctatatttttgtttctcaggcttatcacaatctcagtattatagtttctgcagttagtgaaagaagatctatttctagtaacatgaaagcttccataaggcttgtgttccacttctcacttgctgttttgaggctgcttgcatacattttggtcgtttctttgccacttggtaagtataattgcaactgcataatactttttctatattgtacaattcacattcagttactggaaaacttgtgccccttgtgaggattctgagtgtctttgcttcactgcttcagatatatgatatcgtcaaatattggtaaagttttgggcacttggagatgccggacttcatcattgtcaaggcttctatctgaaaattggactactgcatccgcgaggatcctgcgggcactgactgtgctcttgatagaatgctggcaacggcatggttggccgcacagagaaggagtctacctgatgaaatgcagagagcaagactatgtccaattcagaggtgttgtgcatcaaattgattttaaatgaatacacgtgctcaggtcgaaggtgaagctgggatggcactatgttttgtcatgaaaaggtgttaaggctgaaaagggaatccattgactatgtttcattgagctctgaaggtcataaggatt

SEQ ID NO: 3127 - DNA, 5511 bp, Triticum aestivum
gtaggatgtgtgcggggtgattggaagatccaactataaatattattgatactctcttaaaagatgggatggtgatcaccttgcaataaagagttattttttcgcgaatagcaataaagagttatttgatggcaaaaaaaaatcagatgatgtgggctggcctaggatatatagatatataacacttccccttttatattagaatacttaaacatttcgtacattgcatgttgttatatagcctgcaaaaaaggctttcgcgctgctttatataaaaagcaacatagtcaaactgatgtatggtgatgagaagatcgtcttataaaacagatcatatggaaaaacaagaaaacaatagagtgcacaccctatcacaaaacaatctagactacaactagggggagacttgcaccaagggaaaacgcatgacctcgttgcgcaactcgtaccaaggtgacaccagagagagcccctaccctcccgctcctgatcgtggagcctaagcctgcttgcggacaacaaggatcgcgatggatgccaataagggctcgtgtaaaaagataaggaggaaaaacgacagcccacgcgcgaagccaaggaaacttcgatccagcatccgaacatgcctgccaattggcgacacggtgcaccgaaggtaacctaggccccatgacgacgcccacaggagggagacgacgtaaggagtcgccatcgtcaaaaccgaagagacaatcaagggttttcatccggagccctggctccaagagagggaccacatcgacggccccaagagagatgcgacacccatgtgcatcactgccactagtgtcgaagcacaaggctttcgcctagagcctcttacaggcgtcacatcgaggaaccccgagcatcagcccacccgagggaagagatatcactaccaaacaaggcctccatggttctgggagccgtcactgccgaggcaccaccgacaccgggatcaccaagcgtggcatcctttgccatccacacaaccaaaagatgtccccaccaccgctgccaaggcgcctgctgaaaagccgctctgacggtccgccaccctaggccgccgctccggcgtccaatatcccaacctcgactccacacgcgggcaccaacccccgaaaaccgcactcaccggtggtgacacggaaagcgaaactactccatgcacgacgttcagtgaacgatctctggacgacaaggaatcaaatggctggagctgtactttgtctattcatgatcggtgtgatcaatagcgtcgtccacagatcgggcaaaggccgtcgtccgcataacatcgctccatggaaaggctcttcctttccagtcccacggcacaccacgccgacaccagcaccatctgcggcggtgaccactgaccagcgaacctaactcggtcaaggagaccaaacctggctgggagcacgctaccccatctgcctccaccccacagcacgagcacgggtgtccattcaggtacaacaggggatccacatcagaacatctccaacaatttgtatgttagtttgttggtaaaatatgccatgtcatcaaccaacaccgtaacatacaacaacttcaatggattatatctagcctgcccaatagaatgtgagataataaataaggtgctctctcattctacattggagcttgtgcaaggagtgttgattcatgtacatacaaccttcttctctttcttcatttattgtatgacacatcatcaaaaattctactacaccctttccgatttataaggcatgcacgtatccctaggtttataatttgagcaatataaaataagttgtatattctaaaaattacaccattagaaagtagaaaatctgaaatttttaataatatattttttgtgacaaatagcttgttttacgttggtttatttgtcaacctagatatacgtgcaagccctataaatcggaaaggaggtagtatgtgacaaagtctaccaagaaatatcttataactattgagatgcccttagcgagagctggctgccgattgactgatgaatgaacaaaaatcctatatgacaaagtctaccaagaactattttataactattgccgattgactgatgaatgaaccgttaccgtcttcttgtacagaagtaaacacttgtatacctccaccgccccgatgtcccgcctccgctccgcctccaccgcgccgatgccccgcctccgcctcctcagctgccgctcctactccatctccaccttgccgccgtcacgctcatggtctccccacgccgcctttgccgctgccacagagcgcgtcagcgctgggacgctcaccccggaggacgcacaccacctgttcgacgaattgctgcggcagtccactccggtccccgctcgatccctgaacggcttccttacggccctggcccgtgcgcgggacaccgacgcctgcagagacggccccgccctcgccctcgccctcttcaaccgcacccgccgagaagaggccggctcccgggtggtgtcgcccacaatcttcacctacggcatcctcatgaactgctgctgccacacgcttcgtccggatcttgggcttgccttctttgggcgcgtcctcaggatgggcctgaagacaaatgtggtcgtcgccaccacggtcctcaagtgcctctgcggcgccaaacggacagatgaggctgtgaacatcctgctacatcggatgtccgagctcgggtgtgtgcctgatgacttctcatattccattgttctgaagagcttatgtgatgatggcaggagccagcgagcacttgacctgctccagatgtgggagaaagaacgaggtgtctgctcccccaacgtagtggcatataacatagtcatccatggcttctttaaggaaggtgaagtaagcaaggcatgtgacctgttccatgcaatggtgcagcgaggggttgtgcctaatgtgatgacatataccttgactattgatgcgctgtgcaaggccagagctatggacaaagcaaagttgttcctccggcagatgattgataaaggtgttcgaccgaacaatgtgacatataatgtcatgatccatggatattccactctgggccagtggaaagaagcgggtaaagtgttcagagaaatgtcaagacagggtctcataccagatatcgttacttggacctcgttcatggcctctctctgcaagcatggaagaaccaaagaagctgccaatttttttgattccatgactgccaagggccacaagcctgatttggtcacgtatcatgttctgctccatgggtatggaaccgaaggatgctttgctgatatgattaatctcgttaattcgatggcaaccaaaggtattgttcccgatcgtcaggttttcaacattttaatcgatgcacatgctaaacatggaatgatggatgaagctatgcacatatttactggaatgcagggacaaggagtgtgtccagatgtatggacctattcaactataatatctgcactttgcagaatgggtaggctggctgatggtatggataacttcagccagatgattggtaagggagtagaaccgaacacagttgtttatcactccctaattcagggtttctctacacatggtgatttgaggaaagcgaaggagttggtttatgaaatgagaaacaaaggtattccttgtccaaacattgcattcttcacttctataatggacagtctatgcaaagaaggaagggttatggatgcacatgatatcttcaacttggttacagacataggtgagaaacctaacgtcattacgtttaatacgctgattgatggacattgcttagtcggtgagatggagaaagcatttggagtacttgattccatggtatcagctggcattgaggctgatgtttttacatataacacacttgcttatggctattgtagatgtggaaggattgatgatgggttgattctattcagagaaatgttgcgtaagaaacctaaacccacaacaattacatataacataatactggatgggttatttcgtgctgggagaacagttgctgcaaagaaaatgttccatgagatgatcgaagggggaataacagtgagcatgtccacgtacagtataatccttggaggactttgtaggaataattgtgctgaagaagcgatcaccctgtttcagaaattaggagcaatgaatgtgaaattggatattagaatactcaataccatgatcaatgcaatgttcaaggttcggagaagagaggaagctaacagtttgtttgctgcaatatcagccagtggaatggcacctaatgcttctacctacggcctaatgatagggaatcttctaaaagaaggatcagtgcaagaagccgaaaatatgttctcattaatggagaagagtggttgtgctccaggctctcgtcttataaataatatcatcagaatattattggaaaaaggtgacattgtcaaggctggaaattatatgtctaaagttgatggcaagaccatctcacttgaagcttcaactacttcgttgttgatgtgtctcttttcaagtaaagggagatatcgggaacaaatcaatttgctccctggaaattaccaatttttcaatggagtcagttgatgcaccggactagacagataaacattggcatggtttggagctctctctcaatgatgtcgacatgagttctgttccatgtgctcacaagatcgagctgagtgttcgtgttaccatagcgttttggcccgatgcatgcggctgctgggcgtgcatcctatggacatcgcccctaatctgcatgccatttccatgctcaaggttcgcatcctctcttcctcttaataatatgccagggctgttactaccccagggccttttcctctttattctccttttactttttgaggtcttcatgtttatagttagatgcctgtcattatacaccagaaaaactgtaagagttcctgaactagataccgtcataccgaacaagataacaacattaaacattcttaatacattttcttggtgcagatgtttatgtgatgacgtatgatcttaatctggaaagatctcttgtaggcatgccttgatgttgtttttccttatgttcgctagagggagcaatgtggccatccagttggcgaatttcacgttttcttctccactgatagcacaacctaagttgcacttgttatgaagatctttaattcattccatatgaatttgtcgcatatgttgttcctttttatgaattatatttatttggaattcgatcaagtaccgtagaatgtcgcccatctttggacagataactgttgacgtctcgaattttgcatttgtgtctccaagcactcttattttatcttccttgggcaaagttcttgttacattatgcacttgtgtcatccaagcactctcattttatcttccttgggaaaagttcttgctacattatgcacttgtgtcatccaagcagtc

SEQ ID NO: 3128 - DNA, 4833 bp, Triticum aestivum
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtctccaccatgcctcgcttctcctccagcacgccaatgtcgccaccacgcctccgcctcctcctcctcctccgacttggcgcccgccactcctcctccacctctcatccctcacgcatctgggatccccacgccgccttcgccgccgcgacgcagcgggctcgctctggcacgctcaccacggaggacgcacaccacctgttcgaagaattgctgcggcagggcaatcctgtccaggagcgtcccttgactaactttctggctgcccttgcccgcgcgcccgcgtccccattctgcagcgatggccccgccctggccgtcgccctcttcagccgtttgtcccgaggcgccggacgacgggtggcacagccaaatgttttcacctatggagtcctaatggactgctgctgccgtgcgcgccgcttggatctagcgatcgccttcttcgcccatctcctcaagacgggactggaggcaggccaagtcgttttcggcaccctcctcaagggactctgccacgcaaagcactcagatgaggctttggacgtggtgcttcacaggatgcctgagctaggctgcacccccgacgtggtggcctataccacggtcatccacggcttcttgaaggaaggccaagtaggcaaggcatgcaatctattccatggaatggcgcagcagggcgttgcgcctgatgtggtgacatatagctcagttattgatgcgctgtgcaaggccagagcaattgacaaggcagagtatttccttcgtgaaatggttgataatggtgtcgtacctaataatgtgacatataatagcctcatccatggatattcctctttgggccatcagaaggaggctgttagggtgctgaaagaaatgacaagacagggtatcatacctgatgtttttacttgcaactcggtcatggcctccctttgcaagaacggaaaaagcaaagaagctgcaaaaatgtttgattcaatgtccatgaagggcctgaaacctaacaccgtttcatatgttattctccttcatgggtatgccactgaaggatgcctagttgacatgatcaatctcttcaattccatggcaacagactgtattctacctaactgtcatatattcaacatactgatttatgcatatgctaaatctgggaagctcgacaaggctatgcttatatttaaagaaatgcagaaacaaggagtgagtccagatgcagtcacatattcaaccgtaatacatgcattttgcaaaaagggtaggttggatgatgctgtgataaagtttaatcagatgattgatacaggagtacgaccggacgcatctgtttatcgttccctaatccagggtttttgtacacatggcgatttggtgaaagcaaaggaatatgttactgaaatgatgaagaaaggtatgcttcctcctgatattatgttcttcagttcaatcatgcagaacctatgcacagaaggaagggtaatagaagcacgagatatccttgacttgatagtgtgcattggtatgaggcctgatgttttcatatttaatatactgatcggcggatactgcctagtccgcaagatggcagatgcatcaaaaatatttgatgatatggtgtcatatggtttagaaccttgtaatattacgtatggtatacttattaatggctattgcaaaaacggaaggattgatgacgggcttattctgttcaaggagatgctgcacaagggacttaaacctacaacttttaattataacgtcatactggatggattatttctggctagacaaactgttgctgcaaaggtgaagtttcatgagatggctgaatctggagtaagtgtgtgcattgatacatactctatagttcttggtggactttgtagaaataattgcatcggtgaagcaatcacgctatttcagaaattaagtacaatgaatgttaaattcaatattgcaattgtcaatatcatgattggtgcattcttcagggttcggcgaaaccaggaagctaaggatttgtttgctgcagtatcagccaatggtttggtagctaatgtctttacctacactgtaatgatgataaatcttatagaagaagggtcactggaagaagctgacactctctttttatcaatgaagaagtccggctgtactgccaactcttgtatgttaaatcatattatcagaaggttactggaaagaggagagatagtcaaggctggaaattatatgtcgaaagttgatgcaaagagctactcacttgaagctaaaactgttttgctgctgatctctctcttttcagggaatgggaaatatagagaacacataaaattgctccctatgaagtatcagtttctcgaagaagcagccacagttgaatagaacgcatccatggacgtggattgaattgaaggtgtactactgctgtgctggtccgtggatcgtggctgtcatgcatggtttgctgtgtcttctacgatatgtacttccctttgttccgtatatgtacatcttcctcgtttggttcatgtattttcctttgaataataataaataaatcgggctttccatatcggatgcttttatatctgtgtgtatggagattgtggtatatggtttcatctcaagttgtttacgtcaagaactaaagatatttcctcaaaaaaaaagaactaaagatataatcaatgtcattaacataactcatttccatgaggagaggacgaaggacgaagtcataataagtagattggttgatattttataatcattcaaaactgcaggggttataagatcttcattttgtagaagttttagatcttccgaggggttctc

SEQ ID NO: 3129 - DNA, 4833 bp, Triticum aestivum
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtctccaccatgcctcgcttctcctccaccacgccaatgtcgccaccccgcctcctcctccggctcggcgcccgccactcctcctccacctctcatccctcacgcatctgggatccccacgccgccttcgccgctgcgacgcagcgggcgcgctctggcacgctcaccacggaggacgcacaccacctgtttgatgaattgctgcggcagggcaatcctgtccaggagcgtcccttgactaactttctggctgccctcgcccgcgcgcccgcgtccgcattctgcagcgatggccctgccctggccgtcgccctcttcggccgtttgtcccgaggcgccggacgacgggtggcgcagccaaatgtcttcacctatggcgtcctcatggactgctgctgccgtgcgcgccgcctggatctagcgatcgccttcttcgcccgtctcctcaagacgggactggaggcaaaccaagtcatcttctgcaccctcctcaagggactctgccacgcaaagcgctcagatgaggctttggacgtggtgcttcacaggatgcctgagctaggctgcacccccaacgtggtggcctataccacggtcatccacggcttcttgaaggaaggccaagtaggcaaggcatgcaatctattccatggaatggcgcagcagggcgttgcgcctgatgtggtgacatataactcggttatcgatgcgttgtgcaaggccagagcaatggacaaggcagagtatttccttcgtgaaatggttgataatggtgtcgtacctaataatgtgacatataatagcctcatccatggatattcctctttgggccatcagaaggaggctgttagggtgctgaaagaaatgacaagacagggtatcataccagatgtcattacctgcacctcactcatgaccttcctttgcaagaatggaaaaagcaaggaagctgcagaaatttttgattcaatggccacgaagggcctgaaacatgacgccgtttcatatgctattctccttcatgggtatgccactgaaggatgcttggttgatatgattaatctcttcaattcgatggacagagactgtattctacctaactgtcatatcttcaacatactgatttatgcatatgctaaatctgggaagcttgataaggctatgcttatatttagagatatgcagaaacaaggagtgagcccagatgcattcacatattcaaccttaatacatgcattttgtaaaaagggtcggttggacgatgctatgataaagtttaatcagatggttgatacaggagtacgacagggcacagctgtttatggttctctaatccagggtttttgtacacacggcgatttggtgaaaggaaaggaattggttactgaaatgatgaacaaaggtatacctcctcctgacattatgttcttccattcaatcatgcagaacctatgcacagaaggaagggtagtagaagcacgggatatccttggcttgatagcacacataggtatgaggcctaatgtttgcacatttaatatactgattggtggatactgcctagtccgcaagatggaggatgcctcaaaaatatttcatgatatgatgtcatatggtttagaaccttctaatgttacgtatggtattcttattaatggctattgcaaaaacagaaggattgatgacgggctgattctgttcaaagaaatgttgcgcaagggacttaaacctacaacttttaattacaacatcatactggatggattatttctggctggacgaactgttgctgcaaaggaaaagtttgatgagatggttgaatctggagtaagtatgtgcatcagtacttactctatagttcttcgtggactttgtagaaataattgtagcggcgaagccatcacgctattccagacattaagcgcaatggatgtgaaattcaatattagaattgtcaatatcatgattgatgccttcttcagggttcagcgaaagcaagaagctaaggatttgtttgctgcaataacagccaatgggttggttgctaatgtttttacctacagcctaatgatgacaaatcttataaaagaagggtcagtggaagaggctgacacactctttttatcgatggagatgagcggctgtacttcgaactcgtggatgttaaatcttattatcagagggttgctggaaaaaggagagatagtcaaggctggatgttatatgtctaaagttgatgccaagagctactcacttgaagctaaaactgtttcgttgctgatctatctcttttcagggaaagggaaatacagagaacacataagattgctacctacaaagtatcagtttctcgaagaagcagccacagttgaatggtttgctatatagaacgcatccatggacgtggattgaattgaaggtgtactactgctgtgctggtccgtggatcgtggctgtcatgcatggtttgctgtgtcttctacgatatgtacttccctttgttccgtatatgtacatcttcctcgtttggttcatgtattttcctttgaataataataaataaatcgggctttccatatcggatgcttttatatctgtgtgtatggagattgtggtatatggtttcatctcaagttgtttacgtcaagaactaaagatatttcctcaaaaaaaaagaactaaagatataatcaatgtcattaacataactcatttccatgaggagaggacgaaggacgaagtcataataagtagattggttgatattttataatcattcaaaactgcaggggttataagatcttcattttgtagaagttttagatcttccgaggggttctc

SEQ ID NO: 3130 - DNA, 4812 bp, Triticum aestivum
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtctccaccatgtcgccactccgcctccgcctccgcctccggccccgcctccatgcccgccactcctactccacctcgcatcccccacgcggccagggctgggatccccacgcctccttcgcagctgccacggagcgcgcgcgatctggcaacctctcctcggaggacgcacaccacctgttcgaccaattgctcctgcaggctaatccggtcaacatgcgccttccgaacgaccttctcaccgccctggctcgcgcacctgcgtccgcatcctgcagcaacggccccgccctcgccgtcgccctcttcagccgtttgtcccaaggtgcccgccaacgggtggtgcagccaacggcctgcacctacggcatcctcatggactgctgctgccgcgcaaaccgccaggatctggcgctcgccttcttcgcccgtctcctcaggacgggactcaaggcaggcgtcatagaagtcaacactcttctcaagggactctgccgtgcaaagcgggctgatgaggctctggacattctgcttcacaggatgcctgagctaggctgcacccccaacgtggtggcatataacacggtcatccatggcttcttccaagaaggccaagcaggcaaggcgtgcagcttgttccatgaaatggcgcagcagggcgttgcgcctagtttggtgacatataactcggttattgatgcgctgtgcaaggccagagccatggacaaggcagagtatttccttggtcagatggttgatgatggtgtcatacctgataatgtgacatataatagcctcatccatggatattcctcttcaggccactggaaggaggcagttagggtattcaaagagatgacaagtcggagggttaaaccaaatgtgcatactcacaacatgtttatgacctttctttgcaaacatggaagaagcaaagaagctgcaggaatttttgataccatggctatgaagggcctgaaacataacaacgtttcatatgctattctccttcacgggtatgccaccgaaggatgcttagttgatatgattaatctcttcaattcaatggaaagatactgcattctacctgactgtcgtatcttcaacatactgattcatgcacatgctaaatctgggaagcttgataaggccatgcttatcttcaatgaaatgcagaaacaaggagtgagtccaaatgcagtcacatattcaaccataatacatgcattttgcaaaaagggtaggttggacgatgctgtgataaagtttaatcagatgattgatacaggagtacgacagggcacagctgtttatcgttccctaatccagggtttttgtacacacggcgattcggtgaaagcaaaggaattgctcactgaaatgatgaacaaaggtatgcttcctcctgatattgcattcttcaattcaatcatgcagaacctttgcacagaaggaagggtaatagaagcacgggatgtccttggcttgatagcgcacataggtatgaggcctgatgtttgcacatttaatatactgatcggtggatactgcctagtcggcaagatggaacatgcctcaaaaatatttgatgatatgatgtcatatggcttagaaccttctaatattacgtatggtatacttattaatggctattgcaaaaatagaaggattgatgacgggcttattctgttcaaagagatgctgcacaagggacttaaacctacaacttttaattataacgtcatactggatggattatttctggctggacgaactgttgctgcaaaggaaaagtttgatgagatggttgaatctggagtaagtgtgtgcattggtacatattcgatagttcttggtggactttgtagaaataattgtagcggcgaagcaatcacgctattccagaaattaagcacaatggatgtgaaattcaatattataattgtcaatataatgattgatgctttctacaaggttcagcgaaaccaagaagccaaggatttgtttgctgcagtatcagccaatggtttggtagctaatgtctttacctacaccataatgatgaaaaatcttataaaagaagggtcagtggaagaagctgacgatctctttttatcaatggagaagtccggctgtactgctgactcttatatgttaaatcttatcgtcagaatgttactgggaaaaggagagatagtcaaggctgggaattatatatctaaaattgatgcaaagagctactcacttgaagctaaaactgtttcgctgcttatctctctcttttcagggaaagggaaatatagagaacacataggattgctccctgcaaagtatcggtttcgtgaagaagcagctacagttgtgtagaacgcatccatggacgtggattgaattgaaggtgtactactgctgtgctggtccgtggatcgtggctgtcatgcatggtttgctgtgtcttctacgatatgtacttccctttgttccgtatatgtacatcttcctcgtttggttcatgtattttcctttgaataataataaataaatcgggctttccatatcggatgcttttatatctgtgtgtatggagattgtggtatatggtttcatctcaagttgtttacgtcaagaactaaagatatttcctcaaaaaaaaagaactaaagatataatcaatgtcattaacataactcatttccatgaggagaggacgaaggacgaagtcataataagtagattggttgatattttataatcattcaaaactgcaggggttataagatcttcattttgtagaagttttagatcttccgaggggttctc

SEQ ID NO: 3131 - DNA, 4680 bp, Triticum aestivum
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtctccaccatgcctcgcttctccaccaccacgccaatgtcgccaccccgcctcctcctccgactcggcgcccgccactcctcctccacctctcatccctcacgcatctgggatccccacgccgccttcgccgctgcgacgcagcgggcgcgctctggcacgctcaccacggaggacgcacaccacctgtttgatgaattgctgcggcagggcaatcctgtccaggagcgtcccttgactaactttctggctgccctcgcccgcgcgcccgcgtccgcattctgcagcgatggccctgccctggccgtcgccctcttcggccgtttgtcccgaggcgccggacgacgggtggcgcagccaaatgtcttcacctatggcgtcctcatggactgctgctgccgtgcgcgccgcctggatctagcgatcgccttcttcgcccgtctcctcaagacgggactggaggcaaaccaagtcatcttctgcaccctcctcaagggactctgccacgcaaagcgctcagatgaggctttggacgtggtgcttcacaggatgcctgagctaggctgcacccccaacgtggtggcctataccacggtcatccacggcttcttgaaggaaggccaagtaggcaaggcatgcaatctattccatggaatggcgcagcagggcgttgcgcctgatgtggtgacatataactcggttatcgatgcgttgtgcaaggccagagcaatggacaaggcagagtatttcctttgtgaaatggttgataatggtgtcgtacctaataatgtgacatataatagcctcatccatggatattcctctttgggccatcagaaggaggctgttagggtgctgaaagaaatgacaagacagggtatcataccagatgtcattacctgcacctcactcatgaccttcctttgcaagaatggaaaaagcaaggaagctgcagaaatttttgattcaatgcccacgaagggcctgaaacatgacgccgtttcatatgctattctccttcatgggtatgccactgaaggatgcttggttgatatgattaatctcttcaattcgatggacagagactgtattctacctaactgtcatatcttcaacatactgatttatgcatatgctaaatctgggaagcttgataaggctatgcttatatttagagatatgcagaaacaaggagtgagtccagatgcagtcacatattcaaccgtaatacatgcattttgcaaaaagggtaggttggatgatgctgtgataaagtttaatcagatgattgatacaggagtacgaccggaagcatctgcttatcgttccctaatccagggtttttgtacacatggcgatttggtgaaagcaaaggaatatgttactgaaatgatgaagaaaggtatgcttcctcctgatattatgttcttcagttcaatcatgcagaaactatgcacagaaggaagggtaatagaagcacgagatatccttgacttgatagtgcgcattggtatgaggcctaatgttttcatatttaatatactgatcggtgggtactgcctagtctgcaagatggaggatgcaacaaaaatgtttgaggatatggtgtcatttggtttagaaccttgtaatattacgtatggtatacttattaatggctattgcaaaaatagaaggattgatgatgggcttattctgttccaagagatgctgcacaagggacttaaacctacaacttttaattataatgtcatactggatgggttatttctggctggacgaactgttgctgcaaaggaaaagtttgatgagatggttgaatctggagtaagtgtgtgcagtgatacatattcgatagttcttgctggactttgcagaaataattgctctagcgaagtaatcatgctgttccagaaattaagggcaatgaacatgaaattcaatattagaattgtcactatcatgattgatgccttctacaaggttcggcgaaaccaagaagctaaggatttgtttgctgcaataccatccaatggcttggtagctaatgttgttacctacagcataatgatgaaaagtcttataaaagaaggttcagtggaagaagctgacactctttttatcgatggagaggagcggctgtactgcaaactcttggatgttaaatcatattatcagaaggttactggaaagaggagagatagtcaaggctggaaattatatgtcgaaagttgaaacgcatccatggacgtggattgaattgaaggtgtactactgctgtgctggtccgtggatcgtggctgtcatgcatggtttgctgtgtcttctacgatatgtacttccctttgttccgtatatgtacatcttcctcgtttggttcatgtattttcctttgaataataataaataaatcgggctttccatatcggatgcttttatatctgtgtgtatggagattgtggtatatggtttcatctcaagttgtttacgtcaagaactaaagatatttcctcaaaaaaaaagaactaaagatataatcaatgtcattaacataactcatttccatgaggagaggacgaaggacgaagtcataataagtagattggttgatattttataatcattcaaaactgcaggggttataagatcttcattttgtagaagttttagatcttccgaggggttctc

SEQ ID NO: 3132 - DNA, 5078 bp, Triticum aestivum
gtaggatgtgtgcggggtgattggaagatccaactataaatattattgatactctcttaaaagatgggatggtgatcaccttgcaataaagagttattttttcgcgaatagcaataaagagttatttgatggcaaaaaaaaatcagatgatgtgggctggcctaggatatatagatatataacacttccccttttatattagaatacttaaacatttcgtacattgcatgttgttatatagcctgcaaaaaaggctttcgcgctgctttatataaaaagcaacatagtcaaactgatgtatggtgatgagaagatcgtcttataaaacagatcatatggaaaaacaagaaaacaatagagtgcacaccctatcacaaaacaatctagactacaactagggggagacttgcaccaagggaaaacgcatgacctcgttgcgcaactcgtaccaaggtgacaccagagagagcccctaccctcccgctcctgatcgtggagcctaagcctgcttgcggacaacaaggatcgcgatggatgccaataagggctcgtgtaaaaagataaggaggaaaaacgacagcccacgcgcgaagccaaggaaacttcgatccagcatccgaacatgcctgccaattggcgacacggtgcaccgaaggtaacctaggccccatgacgacgcccacaggagggagacgacgtaaggagtcgccatcgtcaaaaccgaagagacaatcaagggttttcatccggagccctggctccaagagagggaccacatcgacggccccaagagagatgcgacacccatgtgcatcactgccactagtgtcgaagcacaaggctttcgcctagagcctcttacaggcgtcacatcgaggaaccccgagcatcagcccacccgagggaagagatatcactaccaaacaaggcctccatggttctgggagccgtcactgccgaggcaccaccgacaccgggatcaccaagcgtggcatcctttgccatccacacaaccaaaagatgtccccaccaccgctgccaaggcgcctgctgaaaagccgctctgacggtccgccaccctaggccgccgctccggcgtccaatatcccaacctcgactccacacgcgggcaccaacccccgaaaaccgcactcaccggtggtgacacggaaagcgaaactactccatgcacgacgttcagtgaacgatctctggacgacaaggaatcaaatggctggagctgtactttgtctattcatgatcggtgtgatcaatagcgtcgtccacagatcgggcaaaggccgtcgtccgcataacatcgctccatggaaaggctcttcctttccagtcccacggcacaccacgccgacaccagcaccatctgcggcggtgaccactgaccagcgaacctaactcggtcaaggagaccaaacctggctgggagcacgctaccccatctgcctccaccccacagcacgagcacgggtgtccattcaggtacaacaggggatccacatcagaacatctccaacaatttgtatgttagtttgttggtaaaatatgccatgtcatcaaccaacaccgtaacatacaacaacttcaatggattatatctagcctgcccaatagaatgtgagataataaataaggtgctctctcattctacattggagcttgtgcaaggagtgttgattcatgtacatacaaccttcttctctttcttcatttattgtatgacacatcatcaaaaattctactacaccctttccgatttataaggcatgcacgtatccctaggtttataatttgagcaatataaaataagttgtatattctaaaaattacaccattagaaagtagaaaatctgaaatttttaataatatattttttgtgacaaatagcttgttttacgttggtttatttgtcaacctagatatacgtgcaagccctataaatcggaaaggaggtagtatgtgacaaagtctaccaagaaatatcttataactattgagatgcccttagcgagagctggctgccgattgactgatgaatgaacaaaaatcctatatgacaaagtctaccaagaactattttataactattgccgattgactgatgaatgaaccgttaccgtcttcttgtacagaagtaaacacttgtatacctccaccgccccgatggtccgtcctgtagaaaccccaacccgtgaaatcaaaaaactcgacggcctgtgggcattcagtctggatcgcgaaaactgtggaattggtcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcaggtatcaccgtttgtgtgaacaacgaactgaactggcagactatcccgccgggaatggtgattaccgaggaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgatgatgcaccggactagacagataaacattggcatggtttggagctctctctcaatgatgtcgacatgagttctgttccatgtgctcacaagatcgagctgagtgttcgtgttaccatagcgttttggcccgatgcatgcggctgctgggcgtgcatcctatggacatcgcccctaatctgcatgccatttccatgctcaaggttcgcatcctctcttcctcttaataatatgccagggctgttactaccccagggccttttcctctttattctccttttactttttgaggtcttcatgtttatagttagatgcctgtcattatacaccagaaaaactgtaagagttcctgaactagataccgtcataccgaacaagataacaacattaaacattcttaatacattttcttggtgcagatgtttatgtgatgacgtatgatcttaatctggaaagatctcttgtaggcatgccttgatgttgtttttccttatgttcgctagagggagcaatgtggccatccagttggcgaatttcacgttttcttctccactgatagcacaacctaagttgcacttgttatgaagatctttaattcattccatatgaatttgtcgcatatgttgttcctttttatgaattatatttatttggaattcgatcaagtaccgtagaatgtcgcccatctttggacagataactgttgacgtctcgaattttgcatttgtgtctccaagcactcttattttatcttccttgggcaaagttcttgttacattatgcacttgtgtcatccaagcactctcattttatcttccttgggaaaagttcttgctacattatgcacttgtgtcatccaagcagtctacaacagggggttgtgcctaatgagggtgacata

SEQ ID NO: 3133 - DNA, 585 bp, Triticum aestivum
atggatgaagtgagcaagttactagaaaatatgtgctcaattggcttgaaactggatgttgtcacctatagcatactgatagatggttactctaagaatggaaggatagatgatgcattggttgttttcagggaaatgatggacgggaaggttgagccttctgttatcacttttaatattatgattggtgcattgcttaaaggtggcaggaaggaagaagccacagatttgtttaatggtatctggcccaaaggattagtgcccgatgttgttacatatagcttaatgatacaaaaactaatagaagaaggttctctacaagagtctgatgatctattcctttctatggagaagaatggatgtgctgccaactcacatatgctaaatgctatagttagaagcttacttcagaaaggggagattcctagggctgggacttatctgtctaaaattgatgagaggaggttcacctttgaagcttccacagctagcttgttggctgcacttgcgtcaggggggaaaggccaggaatataaggagttactccccgaaaaataccactattttctggaacagggcgctgat

SEQ ID NO: 3134 - DNA, 978 bp, Triticum aestivum; identical to SEQ ID NO: 3108

SEQ ID NO: 3135 - protein, 700 aa, Triticum aestivum
NIKARYHAGDIGTEDALHLFDELLQVAGRSSIHAINCLLTVVGRDCPALGVSLFNRVARAKVAPCSITYAILVDCCCRTGRQDLGFAAMGHVIKMGFTADAMITFSHLLKAICAENKTSYAMDIVLRIMPMFNCIPDVFSYNILFKGLCNEKRSQEALELIQVMVEHGGRCQPDVVSYSTVIDGLLKEGLVGKVYILFCEMIQRGISPNAVTYNSIISGMCKVHAMDKAEQVLQQMPDRGILPNVATYTSLIHGYFSLGQCKEVDRIFKEMSRNGVQPNVVTYNIQMDYLCKNGRCAEARKIFDSMVSLGQKPTVTTYSILLHGYALERSFHEIHCLIDLMVGNGIAPNHFLYNILISAYAKEEMIGEVMHIFKKMRQHGLNPNVATYGAVVNLLSKIGRMDDAMSQFNQMITEGLAPDIIVFTLLISGFCSCGKWEKVDELFSEMLDRGICPNTVFFNIIMDCLCKNERVMEAQDLFDLMVHMGVKPDVCTYNTLIGGYLFIGKMDEVRKLLDNMVSIGLKPNVITYSILIDGYSKNGSIDDALVVSREMLAGKVKPCVITFNIMIGALLKCGRKAEAKDLFDGIWANGLVPDVITYSLMIQKLIEEGSLQESDDLFLSMEKNGCVADSHMLNAIVRSLLQKGEVPRAGTYLSKIDERRFTFEASTASLLVALASGRKSQEYKELLPEKYHYFLEEGTD

SEQ ID NO: 3136 - protein, 711 aa, Triticum aestivum
MSRRFVPVGRRILEQNIKARYHAGDIGTEDALHLFDELLQVAGRSSIHAINCLLTVVGRDCPALGVSLFNRVARSKVAPCSITYAILVDCCCRAGRQDLGFAAMGHVIKMGFTADAMITFSHLLKAICAENKTSYAMDIVLRIMPVFNCIPDVFSYNILFKGLCNEKRSQEALELIQVMVEHGGGCQPDVVSYSTVIDGLLKEGEVNKAYSLFCEMLRQGVSPNVVTCSSIISGMCKLHAMDKAEEVLQQMLDRGILPNVATYTSLIHGYFSLGQCKEVDRIFKEMSRNGVQPNILTYNIQMDYLCKNGRCAEARKIFDSMVSLGQKPTVTTYSILLHGYALERSFHEMHCLIDLMVGNGIAPNHFLYNILISACAKEEMIGEVMHIFKKMRQHGLNPNVVTYGAVVNLLSKIGRMDDAMSQFNQMITEGLAPDIIVFTLLISGFCSCGKWEKVDELFSEMLDRGIYPNTVFFNTIMDCLCKNERVMEAQDLFDLMVHMGVKPDVCTYNTLIGGYLFIGKMDEVRKLLDNMVSIGLKPNVITYSILIDGYSKNGRIDDALVVSREMLAGKVKPCVITFNIMIGALLKCGRKAEAKDLFDGIWANGLVPDVITYSLMIQKLVEEGSLQESDDLFLSMEKNGCVADSHMLNAIVRSLLRKGEVPRAGTYLSKIDERSFTLEASTASLLTALASGGKGQEYKGLLPENYHSFLE

SEQ ID NO: 3137 - protein, 715 aa, Triticum aestivum; identical to SEQ ID NO: 477

SEQ ID NO: 3138 - protein, 715 aa, Triticum aestivum; identical to SEQ ID NO: 477

SEQ ID NO: 3139 - DNA, 2627 bp, Triticum aestivum
ttctgacagtttaacctaccatgcattgattgtggtcgttcttgaagtctaatggagtacaatggttgccaacttgccatagctttactccaaagtttactcaagttatgaagggctgaatatctagcatatgaccatcagtacagcagaaaagtaaggcaaaaggtgccaaggataacttattaggacaaatccaggcctcacaaagctaattaaaaattgcagcttagctgaggccaaatgtgcaactcccttgaagtagtagccatccgtatgtatgaaacacatatactggatcaacaaaatggtgatagtcagaaagtttactactaacttgttggaagaagtactaaaaaaactctagaaaaggttgacagtcagaaagtttactactgtttctccaacgattattacatttcaaacgtactaaaaaaggaaaaggttggaagaagtaacctacaaagagaagttcacccctcgattagcactccagagcatctaggcaaaatctctagaaaaggtttcaatcagtgccctcttccagaaaatagtggtatttttcggggagtaactccttatattcctggcttttccgccctgacgcaagtgcaaccaacaagctagctgtggaagcttcaaaggtgaacctcctctcatcaattttagacagataagtcccagcccttggcacctcccctttctgaagtaagcttctaactatagcatttagcatatgggagtcggcaacacatccattcttctccatagaaaggaatagatcatcagactcttgtagagaaccttcttcaataagtttttgtatcattaagctatatgtaataacatcgggcactaatccgttggcccagataccgtcaaacaaatctttggcttctgccttcctgccacatttaagcaatgcaccaatcataatattaaaagtgataacacaaggcttaaccttcccggccaacatttccctggaaacaaccaatgcatcatctatgcttccattcttagagtaaccatcaatcagtatgctatatgtgataacatttggtttcaagccaattgagaccatattgtcaagtaacttcctcacttcatccatcttaccaatgaacaagtatccacctatcagtgtgttataagtacacacatcaggcttcacacccatgtgtaccatcaggtcgaagagatcttgggcttccataaccctttcatttttgcagaggcagtccataattatgttgaagaacactgtgttgggacagatgccgcgatccaacatctcagaaaatagttcatcaaccttctcccatttgccacaagaacagaaaccactaataaggagggtgaaaactatgatatcaggagctaacccttcagttatcatttgattgaattgggacatagcatcatccattcggccaatcttggaaagtaagtttactaccgctccataggtcgctacattagggttcaatccatgctgccgcatttttttaaatatatgcattacttcaccaatcatttcttctttagcatatgcagatatgagtatgttgtagagaaaatgatttggcgcaataccatttcccaccatcaaatcaatgagacaatgtatctcatgaaaagatcgttccagagcatacccatgaagcaaaatgctgtaggtagtaacagtcggtttttggcccaaactgaccatggaatcaaaaatcttcctagcttctgcgcatcttccattcttgcaaagataatccatctgtatattataagttacaacatttggttgaacaccatttctagacatttctttgaaaatccgatccacctctttgcactgtcctaatgaaaaatatccatgtattagactagtatacgtggcaacatttggcagaattcctctatcaggcatctgttgaagaacctgctcagccttgtccatcgcatgaaccttgcacatgccagagatgattgagttataggtcacagcattcggcgaaattcctctctgtatcatttcacaaaataggatgtaaaccttgcccaccaaaccctctttcaacaagccatcaattacggtgctataggacaccacatcaggttggcagcgacctccatgctcaaccatcacctgaatcagctcgagagcctcttggcttctcttctcgttgcagagacccttgaaaagaatgttgtaagagaagacatccggtatgcagttaaacatgggcattattcggagtacgatgtccattgcatagctggtcttgttctccgcacagatggcctttagtaggtggctgaaagtgatcatagcatctgcagtaaatcccatcttgatgacgtgtcccatggcagcgaaaccaaggtcctggcggccagtgcggcagcagcagtcgaccagaatggcataggtgatactgcagggtgccaccttggcccttgcgacgcggttgaagagggagacgccgagcgcagggcaatcacggccgacaacggtgaggaggcagttgatggcatggatcgaggagcgcccagcaacctggagcaattcgtcaaacaggtggagtgcgtcctcggtgccaatgtctccggcgtggtaccgagccttgatgttc

SEQ ID NO: 3140 - DNA, 3117 bp, Triticum aestivum
ccaccgcgccgagccgccgctgggccttcgcagcaccacgccgccaaacgccgtcgtcgactgagcttcgcgccatggccatggagtggggggccgcgccgaggagaggccccgacgccacctgctctgccggggctttgcccggcagcggcccacggcggcggcgagggggaggggagggatgtggggtggccggcggcggcgagtcagtggttccccccgtgtcgcctcgaggagggacgcgggggttgggagggtcagtgtagctgatcttcagcatctttgcatccagtctagggtgtatgtggtgtggcgtttgtatccggatggttgtatgtcgtcaatgcttcacatataaagcagccgtgagccttttttgttttttaataaaaaaaagagaaacgtttttattcagcaaagccacttcttgagagagccgaggtctcccaggccagtggcggcggcggaaaaacagagtggcggcggtcgtcctcaccggcgggcgtcggggacgcagcgcgcggcgacggagggtcgcattctcttcatcagcgtcagggccgccgcagccagcgccgagcgcggagatctcgtcctcgcccccctcaacgctgcggccgtgtcgaccagctcgccggcggccagatctcctgtacagcgcatttacctactgcagcagctgcaactcgaaggtgagcatcctggcatctcgtccatcttgctctgctttccttccttctaaccccaggttcatgcccaggctgcgccggtggtgagcggcggcggcgccatcctatcccctcgagggattcttccggccaggtggagctatgagccgccgctttgtccccgtcggcagacgcatcttagagcagaacatcaaggctcggtaccacgccggagacattggcaccgaggacgcactccacctgtttgacgaattgctccaggttgctgggcgctcctcgatccatgccatcaactgcctcctcaccgttgtcggccgtgattgccctgcgcttggcgtctccctcttcaatcgcgtcgcaaggtccaaggtggcaccctgcagtatcacctatgccattctggtcgactgctgctgccgcgctggccgccaggaccttggtttcgctgccatgggacacgtcatcaagatgggatttactgcagatgctatgatcactttcagccacctactaaaggccatctgtgcggagaacaagaccagctatgcaatggacatcgtactccgaataatgcccgtgtttaactgcataccggatgtcttctcctacaacattcttttcaagggtctctgcaacgagaagagaagccaagaggctctcgagctgattcaggtgatggttgagcatggaggtggctgccaacctgatgtggtgtcatatagcactgtaattgatggcttgttgaaagagggtgaggtgaacaaggcttacagtctattttgtgaaatgctgcgtcagggggtatcgccgaatgttgtgacctgtagttcaatcatctctggcatgtgcaagcttcatgcgatggacaaagctgaggaggttcttcaacagatgcttgatagaggaattctgccaaatgttgccacgtatactagtctaatacatggatatttttcattaggacagtgcaaagaggttgatcggattttcaaagaaatgtctagaaatggtgttcaaccaaatattttaacttacaatatacagatggattatctttgcaagaatggaagatgcgcagaagctaggaagatttttgattccatggtcagtttgggccaaaaaccgactgttactacctacagcattttgcttcatgggtatgctctggaacgatcttttcatgagatgcattgtctcattgatttgatggtgggaaatggtattgcgccaaatcattttctctacaacatactcatatctgcatgtgctaaagaagaaatgattggtgaagtaatgcatatatttaaaaaaatgcggcagcatggattgaaccctaatgtagtgacctatggagcggtagtaaacttactttccaagattggccgaatggatgatgctatgtcccaattcaatcaaatgataactgaagggttagctcctgatatcatagttttcaccctccttattagtggtttctgttcttgtggcaaatgggagaaggttgatgaactattttctgagatgttggatcgcggcatctatcccaacacagtgttcttcaacacaattatggactgcctttgcaaaaatgaaagggttatggaagcccaagatctcttcgatctgatggtacacatgggtgtgaagcctgatgtgtgtacttataacacactgataggtggatacttgttcattggtaagatggatgaagtgaggaagttacttgacaatatggtctcaattggcttgaaaccaaatgttattacatatagcatactgattgatggttactctaagaatggaaggatagatgatgcattggttgtttccagggaaatgttggccgggaaggttaagccttgtgttatcacttttaatattatgattggtgcattgcttaaatgtggcaggaaggcagaagccaaagatttgtttgacggtatctgggccaacggattagtgcccgacgttattacatatagcttaatgatacaaaaacttgttgaagaaggttctctacaagagtctgatgatctattcctttctatggagaagaatggatgtgttgccgactcccatatgctaaatgctatagttagaagcttacttcggaaaggggaggtgcccagggctgggacttatctgtctaaaattgatgagaggagcttcacccttgaagcttccacagctagcttgttgactgcacttgcttcaggggggaaaggccaagaatataaggggttactccctgaaaactaccactcttttctggaataggacactggttgaaacctgttctacagattttgcctagatgctctggagtgctaatcgagggatgaacttctctttgtaggttatttcttccaaccttttcctttttagtacgtttgaaatgtaataatcgttggagaaactgtagtaaact

SEQ ID NO: 3141 - DNA, 3748 bp, Triticum aestivum
aagtcgtaatggactgattctagttgaggacatcatgcttcccatataatgtaaaagagaaatggaatacagcaactaacttactgctgacaacttcaacgagtggtcgtgcacaagacagtcatgacgatcagtacaattttttttttgtgagtacgcaaagcttctaattaggaggcttgaggtgtacaaagtattggatctggcacaaaagaggaggcttgaggtgtacaaactagggcagaccgtgaagcaaaccacgagggggtgaggcgacggcgatcctaggactggaggaacacagatctacaatggttgctgccaactataacagcatggttaatggagtacaatggttgccaacttgccatagctttactccaaagtttactcaagttatgaagggctgaatatctagcatatgaccatcagtacagcagaaaagtaaggcaaaaggtgccaaggataacttattaggacaaatccaggcctcacaaagctaattaaaaattgcagcttagctgaggccaaatgtgcaactcccttgaagtagtagccatccgtatgtatgaaacacatatactggatcaacaaaatggtgatagtcagaaagtttactactaacttgttggaagaagtactaaaaaaactctagaaaaggttgacagtcagaaagtttactactgtttctccaacgattattacatttcaaacgtactaaaaaaggaaaaggttggaagaagtaacctacaaagagaagttcacccctcgattagcactccagagcatctaggcaaaatctctagaaaaggtttcaatcagtgccctcttccagaaaatagtggtatttttcggggagtaactccttatattcctggcttttccgccctgacgcaagtgcaaccaacaagctagctgtggaagcttcaaaggtgaacctcctctcatcaattttagacagataagtcccagcccttggcacctcccctttctgaagtaagcttctaactatagcatttagcatatgggagtcggcaacacatccattcttctccatagaaaggaatagatcatcagactcttgtagagaaccttcttcaataagtttttgtatcattaagctatatgtaataacatcgggcactaatccgttggcccagataccgtcaaacaaatctttggcttctgccttcctgccacatttaagcaatgcaccaatcataatattaaaagtgataacacaaggcttaaccttcccggccaacatttccctggaaacaaccaatgcatcatctatgcttccattcttagagtaaccatcaatcagtatgctatatgtgataacatttggtttcaagccaattgagaccatattgtcaagtaacttcctcacttcatccatcttaccaatgaacaagtatccacctatcagtgtgttataagtacacacatcaggcttcacacccatgtgtaccatcaggtcgaagagatcttgggcttccataaccctttcatttttgcagaggcagtccataattatgttgaagaacactgtgttgggacagatgccgcgatccaacatctcagaaaatagttcatcaaccttctcccatttgccacaagaacagaaaccactaataaggagggtgaaaactatgatatcaggagctaacccttcagttatcatttgattgaattgggacatagcatcatccattcggccaatcttggaaagtaagtttactaccgctccataggtcgctacattagggttcaatccatgctgccgcatttttttaaatatatgcattacttcaccaatcatttcttctttagcatatgcagatatgagtatgttgtagagaaaatgatttggcgcaataccatttcccaccatcaaatcaatgagacaatgtatctcatgaaaagatcgttccagagcatacccatgaagcaaaatgctgtaggtagtaacagtcggtttttggcccaaactgaccatggaatcaaaaatcttcctagcttctgcgcatcttccattcttgcaaagataatccatctgtatattataagttacaacatttggttgaacaccatttctagacatttctttgaaaatccgatccacctctttgcactgtcctaatgaaaaatatccatgtattagactagtatacgtggcaacatttggcagaattcctctatcaggcatctgttgaagaacctgctcagccttgtccatcgcatgaaccttgcacatgccagagatgattgagttataggtcacagcattcggcgaaattcctctctgtatcatttcacaaaataggatgtaaaccttgcccaccaaaccctctttcaacaagccatcaattacggtgctataggacaccacatcaggttggcagcgacctccatgctcaaccatcacctgaatcagctcgagagcctcttggcttctcttctcgttgcagagacccttgaaaagaatgttgtaagagaagacatccggtatgcagttaaacatgggcattattcggagtacgatgtccattgcatagctggtcttgttctccgcacagatggcctttagtaggtggctgaaagtgatcatagcatctgcagtaaatcccatcttgatgacgtgtcccatggcagcgaaaccaaggtcctggcggccagtgcggcagcagcagtcgaccagaatggcataggtgatactgcagggtgccaccttggcccttgcgacgcggttgaagagggagacgccgagcgcagggcaatcacggccgacaacggtgaggaggcagttgatggcatggatcgaggagcgcccagcaacctggagcaattcgtcaaacaggtggagtgcgtcctcggtgccaatgtctccggcgtggtaccgagccttgatgttctgctctaagatgcgtctgccgacggggacaaagcggcggctcatagctccacctggccggaagaatccctcgaggggataggatggcgccgccgccgctcaccaccggcgcagcctgggcatgaacctggggttagaaggaaggaaagcagagcaagatggaagagatgtcaggatgccaggatgctcaccgtcgagctgcagctgctgcagtaggtaaatgcgatgtacaggagatctgaccgccggcgagctggtcgacacggccgcagcgttgaggggggcgaggacgagatctccgtgctcggcgctggctgcggcggccctgacgccgatgaagagaatgcgaccctccgtcgccgcgcgctgcgtccccgaccgccgccactctgtatttccgccgccgccactggcctgggagacctcggctctctcaagaagtggctttgctgaataaaaacgtttctctttttttttattaaaaaacaaaaaaggctcacggctgctttatatgtgaagcattgacgacatacaaccatccggatacaaaagccacaccacatacaccctagactggatgcaaagatgctgaagatcagctacaccgaccctcccgacccccgcgtccctcctcgaggcgacacgaggggaaccactgactctccgccgccggccaccccacatccctcccctccccctcgccgccgccgtgggccgctgccgggcaaagccccggcagagcaggtggcggcggggcctcttctcggcgcggccccccactccatggccatggcgcaaagctcagtcgacgacggcgtttggcggcgtggt

SEQ ID NO: 3142 - DNA, 3717 bp, Triticum aestivum
ttgaggacatcatgcttcccatataatgtaaaagagaaatggaatacagcaactaacttactgctgacaacttcaacgagtggtcgtgcacaagacagtcatgacgatcagtacaattttttttttgtgagtacgcaaagcttctaattaggaggcttgaggtgtacaaagtattggatctggcacaaaagaggaggcttgaggtgtacaaactagggcagaccgtgaagcaaaccacgagggggtgaggcgacggcgatcctaggactggaggaacacagatctacaatggttgctgccaactataacagcatggttaatggagtacaatggttgccaacttgccatagctttactccaaagtttactcaagttatgaagggctgaatatctagcatatgaccatcagtacagcagaaaagtaaggcaaaaggtgccaaggataacttattaggacaaatccaggcctcacaaagctaattaaaaattgcagcttagctgaggccaaatgtgcaactcccttgaagtagtagccatccgtatgtatgaaacacatatactggatcaacaaaatggtgatagtcagaaagtttactactaacttgttggaagaagtactaaaaaaactctagaaaaggttgacagtcagaaagtttactactgtttctccaacgattattacatttcaaacgtactaaaaaaggaaaaggttggaagaagtaacctacaaagagaagttcacccctcgattagcactccagagcatctaggcaaaatctctagaaaaggtttcaatcagtgccctcttccagaaaatagtggtatttttcggggagtaactccttatattcctggcttttccgccctgacgcaagtgcaaccaacaagctagctgtggaagcttcaaaggtgaacctcctctcatcaattttagacagataagtcccagcccttggcacctcccctttctgaagtaagcttctaactatagcatttagcatatgggagtcggcaacacatccattcttctccatagaaaggaatagatcatcagactcttgtagagaaccttcttcaataagtttttgtatcattaagctatatgtaataacatcgggcactaatccgttggcccagataccgtcaaacaaatctttggcttctgccttcctgccacatttaagcaatgcaccaatcataatattaaaagtgataacacaaggcttaaccttcccggccaacatttccctggaaacaaccaatgcatcatctatgcttccattcttagagtaaccatcaatcagtatgctatatgtgataacatttggtttcaagccaattgagaccatattgtcaagtaacttcctcacttcatccatcttaccaatgaacaagtatccacctatcagtgtgttataagtacacacatcaggcttcacacccatgtgtaccatcaggtcgaagagatcttgggcttccataaccctttcatttttgcagaggcagtccataattatgttgaagaacactgtgttgggacagatgccgcgatccaacatctcagaaaatagttcatcaaccttctcccatttgccacaagaacagaaaccactaataaggagggtgaaaactatgatatcaggagctaacccttcagttatcatttgattgaattgggacatagcatcatccattcggccaatcttggaaagtaagtttactaccgctccataggtcgctacattagggttcaatccatgctgccgcatttttttaaatatatgcattacttcaccaatcatttcttctttagcatatgcagatatgagtatgttgtagagaaaatgatttggcgcaataccatttcccaccatcaaatcaatgagacaatgtatctcatgaaaagatcgttccagagcatacccatgaagcaaaatgctgtaggtagtaacagtcggtttttggcccaaactgaccatggaatcaaaaatcttcctagcttctgcgcatcttccattcttgcaaagataatccatctgtatattataagttacaacatttggttgaacaccatttctagacatttctttgaaaatccgatccacctctttgcactgtcctaatgaaaaatatccatgtattagactagtatacgtggcaacatttggcagaattcctctatcaggcatctgttgaagaacctgctcagccttgtccatcgcatgaaccttgcacatgccagagatgattgagttataggtcacagcattcggcgaaattcctctctgtatcatttcacaaaataggatgtaaaccttgcccaccaaaccctctttcaacaagccatcaattacggtgctataggacaccacatcaggttggcagcgacctccatgctcaaccatcacctgaatcagctcgagagcctcttggcttctcttctcgttgcagagacccttgaaaagaatgttgtaagagaagacatccggtatgcagttaaacatgggcattattcggagtacgatgtccattgcatagctggtcttgttctccgcacagatggcctttagtaggtggctgaaagtgatcatagcatctgcagtaaatcccatcttgatgacgtgtcccatggcagcgaaaccaaggtcctggcggccagtgcggcagcagcagtcgaccagaatggcataggtgatactgcagggtgccaccttggcccttgcgacgcggttgaagagggagacgccgagcgcagggcaatcacggccgacaacggtgaggaggcagttgatggcatggatcgaggagcgcccagcaacctggagcaattcgtcaaacaggtggagtgcgtcctcggtgccaatgtctccggcgtggtaccgagccttgatgttctgctctaagatgcgtctgccgacggggacaaagcggcggctcatagctccacctggccggaagaatccctcgaggggataggatggcgccgccgccgctcaccaccggcgcagcctgggcatgaacctggggttagaaggaaggaaagcagagcaagatggaagagatgtcaggatgccaggatgctcaccgtcgagctgcagctgctgcagtaggtaaatgcgatgtacaggagatctgaccgccggcgagctggtcgacacggccgcagcgttgaggggggcgaggacgagatctccgtgctcggcgctggctgcggcggccctgacgccgatgaagagaatgcgaccctccgtcgccgcgcgctgcgtccccgaccgccgccactctgtatttccgccgccgccactggcctgggagacctcggctctctcaagaagtggctttgctgaataaaaacgtttctctttttttttattaaaaaacaaaaaaggctcacggctgctttatatgtgaagcattgacgacatacaaccatccggatacaaaagccacaccacatacaccctagactggatgcaaagatgctgaagatcagctacaccgaccctcccgacccccgcgtccctcctcgaggcgacacgaggggaaccactgactctccgccgccggccaccccacatccctcccctccccctcgccgccgccgtgggccgctgccgggcaaagccccggcagagcaggtggcggcggggcctcttctcggcgcggccccccactccatggccatggcgcaaagctcagtcgacgacggcgtttggc

SEQ ID NO: 3143 - protein, 790 aa, Triticum aestivum
MPRFSSTTPMSPPRLRLRLRLCARHSSSTSHPSRIWDPHAAFAAAAQRASSGTLTTEDAHHLFDELLRRGNPVQERPLNKFLAALARAPASASCCDGPALAVTLFGRLSRDVGRRVAQPNVFTYGVLMDCCCRACRTDLVLAFFGRLLKTGLEANQVVFNTLLKGLCHTKRADEALDVLLHRMPELGCTPNVVAYNTVIHGFFKEGHVSKACNLFHEMAQQGVKPNVVTYNSVIDALCKARAMDKAEVVLRQMIDDGVGPDNVTYSSLIHGYSSSGHWKEAVRVFKEMTSRRVTADVHTYNMFMTFLCKHGRSKEAAGIFDTMAIKGLKPDNVSYAIRLHGYATEGCLVDMINLFNSMATHCILPNCHIFNILINAYAKSGKLDKAMLIFNEMQKQGVSPNAVTYSTVIHAFCKKGRLDDAVIKFNQMIDTGVRPDASVYRPLIQGFCTHGDLVKAKEYVTEMMKKGMPPPDIMFFSSIMQNLCTEGRVTEARDILDLIVHIGMRPNVIIFNLLIGGYCLVRKMADALKVFDDMVSYGLEPCNFTYGILINGYCKNRRIDDGLILFKEMLHKGLKPTTFNYNVILDGLFLAGQTVAAKEKFDEMVESGVSVCIDTYSIILGGLCRNSCSSEAITLFRKLSAMNVKFDITIVNIIIGALYRVERNQEAKDLFAAMPANGLVPNAVTYTVMMTNLIKEGSVEEADNLFLSMEKSGCTANSCLLNHIIRRLLEKGEIVKAGNYMSKVDAKSYSLEAKTVSLLISLFSRKGKYREHIKLLPTKYQFLEEAATVE

SEQ ID NO: 3144 - protein, 546 aa, Triticum aestivum
MPGFSSAASMSPLRLRLRLHARHSSSASQPSRRQGWDPHAAFAAATECARSGNLTPEDAHHLFDELLRQGNPVLGRPLNNLLAALARAPASSACRDGPALAVALFSRISQGARLRVLHPTACTYGILMDCSCRAHRLNLAFAFFGRLLRTGLKAGVIEVNSLLKGLCHAKRADEAMEVLLHRMPELFIGVQGTAVYRSLIQGFCTHGDLVKAKEYVTEMMKKGMPPPDIMFFSSIMQNLCTEGRVIEARDILDLIVRIGMRPDVFIFNILIGGYCLVGKMEDASKIFDDMVSYGLEPCNFTYGILINGYCKNKRIDDGLILFKEMLRKGLKPTTFNYNVILDGLFLAGQTVAAKEKFDEMVESGVSVCIDTYSIVLGGLCRNSCSSEAITLFRKLSAMNVKFNITIVNTIIGAFYRVERNQEAKDLFAAIPASGLVPNVVTYTIMIKNLIKEGSVEEADNLFLSMEKSGCSANSYLLNHIIRRLLEKGEIVKAGNYMSKVDAKSYSLEAKTVSLLISLFSRKGKYREHIKLLPTKYQFLEEAATVE

SEQ ID NO: 3145 - protein, 608 aa, Triticum aestivum
MPELGCTPNVVAYTTVIHGFFKEGQVGKACNLFHGMAQQGVAPNLVTYNSVIDALCKAKAMDKAEYFLGQMVDDGVVPDNVTYNSLIHGYSSSGHWKEAVRVFKEMTSRRVTADVHTYNMFMTFLCKHGRSKEAAGIFDTMAMKGLKPDNVSYAILLHGYATEGCLVDMINLFNSMERDCILPDCRIFNILINAYAKSGKLDKAMLIFNEMQKQGVSPNAVTYSTVIDAFCKKGQLDDAMIKFNQMIDTGVRQGTAVYGSLIQGFCTHGDLVKAKELLTEMMNKGMLPPDIKFFHSIMQNLCTEGRVIEARDVLGLIAHIGMRPDVCTFNILIGGYCLVGKMEDASKIFDDMMSYGLEPSNITYGILINGYCKNRRIDDGLILFKEMLHKGLKPTTFNYNIILDGLLLAGRTVAAKEKFNEMVESGVSVCTDTYSIVLGGLRRNNCFSEAIMLFQKLRAMNMKFNIRIVNIMIDAFFRVQRKQEAKDLFAAIPANGLVANVVTYSITMTNLIKEGSVEEADDLFLSMEKSGCTADSYMLNLIVRMLLEKGELVKAGNYMSKVDAMSYSLEAETVSLLISLFSGKGKYREHIGLLPAKYRFREEAATVV

SEQ ID NO: 3146 - DNA, 2367 bp, Triticum aestivum
atgccccgcttctcctccaccacgccaatgtcgccaccccgcctccgcctccgactctgcgcccgccactcctcctccacctctcatccctcacgcatctgggatccccacgccgccttcgccgccgcggcacagcgggcgagctctggcacgctcactacggaggacgcacaccacctgtttgacgaattgctgcggcggggcaatcctgtccaggagcgtcccttgaataaatttctggctgccctcgcccgcgcgcccgcgtccgcatcctgctgcgatggccccgccctggcagtcgccctcttcggccgtttgtcccgagacgtcggacgacgggtggcgcagccaaatgtcttcacctatggcgtcctcatggactgctgctgccgcgcttgccgcacagatctggtgctcgccttctttggccgtctcctcaagacgggcctggaggcaaaccaagtcgtcttcaacaccctcctcaagggcctttgccacacaaagcgggcggatgaggctctggacgtgctgcttcacaggatgcctgagctgggctgcactcctaatgtggtggcgtataacaccgttatccatggcttctttaaggaaggccatgtaagcaaggcctgcaatctgttccatgaaatggcgcagcagggcgttaagcctaatgtggtgacatataactcagttatcgatgcgctgtgcaaggccagagccatggacaaggcagaggtggtccttcgtcagatgattgatgatggtgttggacctgataatgtgacgtatagtagcctcatccatggatattcctcttcaggccactggaaggaggcagttagggtattcaaagagatgacaagtcggagggttacagcagatgtgcatacttacaacatgtttatgacctttctttgcaaacatggaagaagcaaagaagctgcaggaatttttgataccatggctatcaagggcctgaaacctgacaacgtttcatatgctattctccttcatgggtatgccgccgaaggatgcttagttgatatgattaatctcttcaattcaatggaaagagattgtattctacctgactgtcgtatcttcaacatactgattaatgcatatgctaaatctgggaagcttgataaggctatgcttatcttcaatgaaatgcagaaacaaggagtgagtccaaatgcagtcacatattcaaccgtaatacatgcattttgcaagaagggtaggttggatgatgctgtgataaagtttaatcagatgattgatacaggagtacgaccggacgcatctgtttatcgtcccctaatccagggtttttgtacacatggcgatttggtgaaagcaaaggaatatgttactgaaatgatgaagaaaggtatgcctcctcctgatattatgttcttcagttcaatcatgcagaacctatgcacagaaggaagggtaacagaagcacgggatatccttgacttgatagtgcacattggtatgaggcctaatgttatcatatttaatttgctgatcggtggatactgcctagtccgcaagatggcagatgcattgaaagtatttgatgatatggtgtcatatggtttagaaccttgtaactttacgtatggtatacttattaatggctattgcaaaaatagaaggattgatgacgggcttattctgttcaaagagatgctgcacaagggacttaaacctacaacttttaattataacgtcatactggatggattatttctggctggacaaactgttgctgcaaaagagaagtttgatgagatggttgaatctggagtaagtgtgtgcattgatacatactctataattcttggtggactttgtagaaatagctgcagtagcgaagcgatcacccttttccggaaattaagcgcaatgaatgtgaaatttgatattacaattgtcaatatcattattggtgccttatacagggtcgagagaaaccaagaggctaaggatttgtttgctgctatgccagccaatggcttggttcctaatgctgttacctacaccgtaatgatgacaaatcttataaaagaaggttcagtggaagaagctgacaatcttttcttatccatggagaagagcggctgtactgccaactcttgcctgttaaatcatatcatcagaaggttactggaaaaaggagagatagtcaaggctggaaattatatgtctaaagttgatgcaaagagctactcacttgaagctaaaactgtttcgctgctgatctctctgttttcaaggaaagggaaatatagagaacacatcaaattgcttcctacaaagtatcagtttctggaagaagcagccacagttgaatag

SEQ ID NO: 3147 - DNA, 1176 bp, Triticum aestivum
atgcctggcttctcctccgccgcgtcaatgtcgccactgcgcctccgcctccgcctgcacgcccgccactcctccgcctcgcaaccctcacgccgccagggatgggatccccacgccgccttcgccgccgccacggagtgtgcgcgctccggcaacctcaccccggaggacgcacataacctgttcgacgaattgctgcggcagggcaatcctgtccttgggcgccccctcaacaaccttctcgccgccctcgcccgcgcgccggcgtccagcgcctgcagagatggccccgcactcgtggtcgccctcttcagccgcatatcccaaggcgcccgcctaagggtgctgcacccaacggcctgcacctacggcatcctcatggactgcagctgccgcgcacaccgcctcgatctggcgtttgccttcttcggccgtctcctcaggacgggactgaaggcaggcgtcatagaagtcaacagtctcctcaaaggactctgccacgcaaagcgggcggatgaggccatggaagtgcttcttcacaggatgcctgagctgtttataggagtacagggcacagctgtttatcgttccctaatccagggattttgtacacacggcgatttggtgaaagcaaaggaatatgttactgaaatgatgaagaaaggtatgcctcctcctgatattatgttcttcagttcaatcatgcagaacctatgcacagaaggaagggtaatagaagcacgagatatccttgacttgatagtgcgcattggtatgaggcctgatgttttcatatttaatatactgatcggtggatactgcctagtcggcaagatggaggatgcctcaaaaatatttgatgatatggtgtcatatggtttagaaccttgtaactttacgtatggtatacttattaatggctattgcaaaaataaaaggattgatgacgggcttattctgttcaaagagatgctgcgcaagggacttaaacctacaacttttaattataacgtcatactggatggattatttctggctggacaaactgttgctgcaaaagagaagtttgatgagatggttgaatctggagtaagtgtgtgcattgatacatactctatagttcttggtggactttgtagaaatagctgcagtagcgaagcgatcaccctgttctga

SEQ ID NO: 3148 - DNA, 1629 bp, Triticum aestivum
atgcctcgcctctcctccaccacgccaatgtcaccaccacgcctccgcctccgactccgcggccgccactcctcctccacctctcatccctcacgcatctgggatccccacgccgccttcgccggcgcgacgcagcgggcgcactctggcaacctcaccccggaggacgcacaccacctgttcgacgaattgctgcggcagggcaatcctgtccaggagcgtcccttgactaactttctggctgccctcgcccgcgcgcccgcgtccgcatcctgcagcgatggccccgccctggccgtagccctcttcggtcgtttgtcccgaggcgccggacgacgcgtggcacagccaaatgtcttcacctatggcgtcctcatggactgctgctgccgcgcgtgccgcccggatctggcgctcgctttcttcggccgtctcttcaggaagggcctggaggcaaaccgagtcatcttctgcaccctcctcaagggactctgccacgcaaagcgcacagatgaggctctggacgtgctgcttcacaggatgcctgagctgggctgcacccccaacgtggtggcatataccacggtcatccacggcttctttaaggaaggccaagtaggcaaggcatgcaatctgttccatggaatggcgcagcagggcgttgcgcctaatttggtgacatataactcggttattgatgcgttgtgcaaggccaaagcaatggacaaggcagagtatttccttggtcagatggttgatgatggtgtcgtacctgataatgtgacatataatagcctcatccatggatattcctcttcaggccactggaaggaggcagttagggtattcaaagagatgacaagtcggagggttacagcagatgtgcatacttacaacatgtttatgacctttctttgcaaacatggaagaagcaaagaagctgcaggaatttttgataccatggctattaagggcctgaaacctgacaacgtttcatatgctattctccttcatgggtatgccaccgaaggatgcttagttgatatgattaatctcttcaattcaatggaaagagattgtattctacctgactgtcgtatcttcaacatactgattaatgcatatgctaaatctgggaagcttgataaggctatgcttatcttcaatgaaatgcagaaacaaggagtgagtccaaatgcagtcacatattcaaccgtaatacatacattttgcaaaaagggtaggttggatgatgctgtgataaagtttaatcagatgattgatacaggagtacgacagggcacagctgtttatggttctctaatccagggtttttgtacacacggcgatttggtgaaagcaaaggaattgcttactgaaatgatgaacaaaggtatgcttcctcctgatatcaagttcttccattcaatcatgcagaacctttgcacagaaggaagggtaatagaagcacgggatgtccttggcttgatagcgcacataggtatgaggcctgatgtttgcacatttaatatactgatcggtggatactgcctagtcggcaagatggaggatgcctcaaaaatatttgatgatatgatgtcatatggcttagaaccttctaattgttag

SEQ ID NO: 3149 - DNA, 2373 bp, Triticum aestivum
atgccccgcttctcctccaccacgccaatgtcgccaccccgcctccgcctccgcctccgactctgcgcccgccactcctcctccacctctcatccctcacgcatctgggatccccacgccgccttcgccgccgcggcacagcgggcgagctctggcacgctcactacggaggacgcacaccacctgtttgacgaattgctgcggcggggcaatcctgtccaggagcgtcccttgaataaatttctggctgccctcgcccgcgcgcccgcgtccgcatcctgctgcgatggccccgccctggcagtcaccctcttcggccgtttgtcccgagacgtcggacgacgggtggcgcagccaaatgtcttcacctatggcgtcctcatggactgctgctgccgcgcttgccgcacagatctggtgctcgccttctttggccgtctcctcaagacgggcctggaggcaaaccaagtcgtcttcaacaccctcctcaagggcctttgccacacaaagcgggcggatgaggctctggacgtgctgcttcacaggatgcctgagctgggctgcactcctaatgtggtggcgtataacaccgttatccatggcttctttaaggaaggccatgtaagcaaggcctgcaatctgttccatgaaatggcgcagcagggcgttaagcctaatgtggtgacatataactcagttattgatgcgctgtgcaaggccagagccatggacaaggcagaggtggtccttcgtcagatgattgatgatggtgttggacctgataatgtgacgtatagtagcctcatccatggatattcctcttcaggccactggaaggaggcagttagggtattcaaagagatgacaagtcggagggttacagcagatgtgcatacttacaacatgtttatgacctttctttgcaaacatggaagaagcaaagaagctgcaggaatttttgataccatggctatcaagggcctgaaacctgacaacgtttcatatgctattcgccttcatgggtatgccaccgaaggatgcctagttgacatgatcaatctcttcaattccatggcaacacactgcattctacctaactgtcatatattcaacatactgattaatgcatatgctaaatctgggaagcttgataaggctatgcttatcttcaatgaaatgcagaaacaaggagtgagtccaaatgcagtcacatattcaaccgtaatacatgcattttgcaagaagggtaggttggatgatgctgtgataaagtttaatcagatgattgatacaggagtacgaccggacgcatctgtttatcgtcccctaatccagggtttttgtacacatggcgatttggtgaaagcaaaggaatatgttactgaaatgatgaagaaaggtatgcctcctcctgatattatgttcttcagttcaatcatgcagaacctatgcacagaaggaagggtaacagaagcacgggatatccttgacttgatagtgcacattggtatgaggcctaatgttatcatatttaatttgctgatcggtggatactgcctagtccgcaagatggcagatgcattgaaagtatttgatgatatggtgtcatatggtttagaaccttgtaactttacgtatggtatacttattaatggctattgcaaaaatagaaggattgatgacgggcttattctgttcaaagagatgctgcacaagggacttaaacctacaacttttaattataacgtcatactggatggattatttctggctggacaaactgttgctgcaaaagagaagtttgatgagatggttgaatctggagtaagtgtgtgcattgatacatactctataattcttggtggactttgtagaaatagctgcagtagcgaagcgatcacccttttccggaaattaagcgcaatgaatgtgaaatttgatattacaattgtcaatatcattattggtgccttatacagggtcgagagaaaccaagaggctaaggatttgtttgctgctatgccagccaatggcttggttcctaatgctgttacctacaccgtaatgatgacaaatcttataaaagaaggttcagtggaagaagctgacaatcttttcttatccatggagaagagcggctgtactgccaactcttgcctgttaaatcatatcatcagaaggttactggaaaaaggagagatagtcaaggctggaaattatatgtctaaagttgatgcaaagagctactcacttgaagctaaaactgtttcgctgctgatctctctgttttcaaggaaagggaaatatagagaacacatcaaattgcttcctacaaagtatcagtttctggaagaagcagccacagttgaatag

SEQ ID NO: 3150 - DNA, 4821 bp, Triticum aestivum
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtctccaccatgccccgcttctcctccaccacgccaatgtcgccaccccgcctccgcctccgactctgcgcccgccactcctcctccacctctcatccctcacgcatctgggatccccacgccgccttcgccgccgcggcacagcgggcgagctctggcacgctcactacggaggacgcacaccacctgtttgacgaattgctgcggcggggcaatcctgtccaggagcgtcccttgaataaatttctggctgccctcgcccgcgcgcccgcgtccgcatcctgctgcgatggccccgccctggcagtcgccctcttcggccgtttgtcccgagacgtcggacgacgggtggcgcagccaaatgtcttcacctatggcgtcctcatggactgctgctgccgcgcttgccgcacagatctggtgctcgccttctttggccgtctcctcaagacgggcctggaggcaaaccaagtcgtcttcaacaccctcctcaagggcctttgccacacaaagcgggcggatgaggctctggacgtgctgcttcacaggatgcctgagctgggctgcactcctaatgtggtggcgtataacaccgttatccatggcttctttaaggaaggccatgtaagcaaggcctgcaatctgttccatgaaatggcgcagcagggcgttaagcctaatgtggtgacatataactcagttatcgatgcgctgtgcaaggccagagccatggacaaggcagaggtggtccttcgtcagatgattgatgatggtgttggacctgataatgtgacgtatagtagcctcatccatggatattcctcttcaggccactggaaggaggcagttagggtattcaaagagatgacaagtcggagggttacagcagatgtgcatacttacaacatgtttatgacctttctttgcaaacatggaagaagcaaagaagctgcaggaatttttgataccatggctatcaagggcctgaaacctgacaacgtttcatatgctattctccttcatgggtatgccgccgaaggatgcttagttgatatgattaatctcttcaattcaatggaaagagattgtattctacctgactgtcgtatcttcaacatactgattaatgcatatgctaaatctgggaagcttgataaggctatgcttatcttcaatgaaatgcagaaacaaggagtgagtccaaatgcagtcacatattcaaccgtaatacatgcattttgcaagaagggtaggttggatgatgctgtgataaagtttaatcagatgattgatacaggagtacgaccggacgcatctgtttatcgtcccctaatccagggtttttgtacacatggcgatttggtgaaagcaaaggaatatgttactgaaatgatgaagaaaggtatgcctcctcctgatattatgttcttcagttcaatcatgcagaacctatgcacagaaggaagggtaacagaagcacgggatatccttgacttgatagtgcacattggtatgaggcctaatgttatcatatttaatttgctgatcggtggatactgcctagtccgcaagatggcagatgcattgaaagtatttgatgatatggtgtcatatggtttagaaccttgtaactttacgtatggtatacttattaatggctattgcaaaaatagaaggattgatgacgggcttattctgttcaaagagatgctgcacaagggacttaaacctacaacttttaattataacgtcatactggatggattatttctggctggacaaactgttgctgcaaaagagaagtttgatgagatggttgaatctggagtaagtgtgtgcattgatacatactctataattcttggtggactttgtagaaatagctgcagtagcgaagcgatcacccttttccggaaattaagcgcaatgaatgtgaaatttgatattacaattgtcaatatcattattggtgccttatacagggtcgagagaaaccaagaggctaaggatttgtttgctgctatgccagccaatggcttggttcctaatgctgttacctacaccgtaatgatgacaaatcttataaaagaaggttcagtggaagaagctgacaatcttttcttatccatggagaagagtggctgtactgccaactcttgcctgttaaatcatatcatcagaaggttactggaaaaaggagagatagtcaaggctggaaattatatgtctaaagttgatgcaaagagctactcacttgaagctaaaactgtttcgctgctgatctctctgttttcaaggaaagggaaatatagagaacacatcaaattgcttcctacaaagtatcagtttctggaagaagcagccacagttgaatagaacgcatccatggacgtggattgaattgaaggtgtactactgctgtgctggtccgtggatcgtggctgtcatgcatggtttgctgtgtcttctacgatatgtacttccctttgttccgtatatgtacatcttcctcgtttggttcatgtattttcctttgaataataataaataaatcgggctttccatatcggatgcttttatatctgtgtgtatggagattgtggtatatggtttcatctcaagttgtttacgtcaagaactaaagatatttcctcaaaaaaaaagaactaaagatataatcaatgtcattaacataactcatttccatgaggagaggacgaaggacgaagtcataataagtagattggttgatattttataatcattcaaaactgcaggggttataagatcttcattttgtagaagttttagatcttccgaggggttctc

SEQ ID NO: 3151 - DNA, 4827 bp, Triticum aestivum
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtctccaccatgccccgcttctcctccaccacgccaatgtcgccaccccgcctccgcctccgcctccgactctgcgcccgccactcctcctccacctctcatccctcacgcatctgggatccccacgccgccttcgccgccgcggcacagcgggcgagctctggcacgctcactacggaggacgcacaccacctgtttgacgaattgctgcggcggggcaatcctgtccaggagcgtcccttgaataaatttctggctgccctcgcccgcgcgcccgcgtccgcatcctgctgcgatggccccgccctggcagtcaccctcttcggccgtttgtcccgagacgtcggacgacgggtggcgcagccaaatgtcttcacctatggcgtcctcatggactgctgctgccgcgcttgccgcacagatctggtgctcgccttctttggccgtctcctcaagacgggcctggaggcaaaccaagtcgtcttcaacaccctcctcaagggcctttgccacacaaagcgggcggatgaggctctggacgtgctgcttcacaggatgcctgagctgggctgcactcctaatgtggtggcgtataacaccgttatccatggcttctttaaggaaggccatgtaagcaaggcctgcaatctgttccatgaaatggcgcagcagggcgttaagcctaatgtggtgacatataactcagttattgatgcgctgtgcaaggccagagccatggacaaggcagaggtggtccttcgtcagatgattgatgatggtgttggacctgataatgtgacgtatagtagcctcatccatggatattcctcttcaggccactggaaggaggcagttagggtattcaaagagatgacaagtcggagggttacagcagatgtgcatacttacaacatgtttatgacctttctttgcaaacatggaagaagcaaagaagctgcaggaatttttgataccatggctatcaagggcctgaaacctgacaacgtttcatatgctattcgccttcatgggtatgccaccgaaggatgcctagttgacatgatcaatctcttcaattccatggcaacacactgcattctacctaactgtcatatattcaacatactgattaatgcatatgctaaatctgggaagcttgataaggctatgcttatcttcaatgaaatgcagaaacaaggagtgagtccaaatgcagtcacatattcaaccgtaatacatgcattttgcaagaagggtaggttggatgatgctgtgataaagtttaatcagatgattgatacaggagtacgaccggacgcatctgtttatcgtcccctaatccagggtttttgtacacatggcgatttggtgaaagcaaaggaatatgttactgaaatgatgaagaaaggtatgcctcctcctgatattatgttcttcagttcaatcatgcagaacctatgcacagaaggaagggtaacagaagcacgggatatccttgacttgatagtgcacattggtatgaggcctaatgttatcatatttaatttgctgatcggtggatactgcctagtccgcaagatggcagatgcattgaaagtatttgatgatatggtgtcatatggtttagaaccttgtaactttacgtatggtatacttattaatggctattgcaaaaatagaaggattgatgacgggcttattctgttcaaagagatgctgcacaagggacttaaacctacaacttttaattataacgtcatactggatggattatttctggctggacaaactgttgctgcaaaagagaagtttgatgagatggttgaatctggagtaagtgtgtgcattgatacatactctataattcttggtggactttgtagaaatagctgcagtagcgaagcgatcacccttttccggaaattaagcgcaatgaatgtgaaatttgatattacaattgtcaatatcattattggtgccttatacagggtcgagagaaaccaagaggctaaggatttgtttgctgctatgccagccaatggcttggttcctaatgctgttacctacaccgtaatgatgacaaatcttataaaagaaggttcagtggaagaagctgacaatcttttcttatccatggagaagagtggctgtactgccaactcttgcctgttaaatcatatcatcagaaggttactggaaaaaggagagatagtcaaggctggaaattatatgtctaaagttgatgcaaagagctactcacttgaagctaaaactgtttcgctgctgatctctctgttttcaaggaaagggaaatatagagaacacatcaaattgcttcctacaaagtatcagtttctggaagaagcagccacagttgaatagaacgcatccatggacgtggattgaattgaaggtgtactactgctgtgctggtccgtggatcgtggctgtcatgcatggtttgctgtgtcttctacgatatgtacttccctttgttccgtatatgtacatcttcctcgtttggttcatgtattttcctttgaataataataaataaatcgggctttccatatcggatgcttttatatctgtgtgtatggagattgtggtatatggtttcatctcaagttgtttacgtcaagaactaaagatatttcctcaaaaaaaaagaactaaagatataatcaatgtcattaacataactcatttccatgaggagaggacgaaggacgaagtcataataagtagattggttgatattttataatcattcaaaactgcaggggttataagatcttcattttgtagaagttttagatcttccgaggggttctc

SEQ ID NO: 3152 - DNA, 3630 bp, Triticum aestivum
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtctccaccatgcctggcttctcctccgccgcgtcaatgtcgccactgcgcctccgcctccgcctgcacgcccgccactcctccgcctcgcaaccctcacgccgccagggatgggatccccacgccgccttcgccgccgccacggagtgtgcgcgctccggcaacctcaccccggaggacgcacataacctgttcgacgaattgctgcggcagggcaatcctgtccttgggcgccccctcaacaaccttctcgccgccctcgcccgcgcgccggcgtccagcgcctgcagagatggccccgcactcgtggtcgccctcttcagccgcatatcccaaggcgcccgcctaagggtgctgcacccaacggcctgcacctacggcatcctcatggactgcagctgccgcgcacaccgcctcgatctggcgtttgccttcttcggccgtctcctcaggacgggactgaaggcaggcgtcatagaagtcaacagtctcctcaaaggactctgccacgcaaagcgggcggatgaggccatggaagtgcttcttcacaggatgcctgagctgtttataggagtacagggcacagctgtttatcgttccctaatccagggattttgtacacacggcgatttggtgaaagcaaaggaatatgttactgaaatgatgaagaaaggtatgcctcctcctgatattatgttcttcagttcaatcatgcagaacctatgcacagaaggaagggtaatagaagcacgagatatccttgacttgatagtgcgcattggtatgaggcctgatgttttcatatttaatatactgatcggtggatactgcctagtcggcaagatggaggatgcctcaaaaatatttgatgatatggtgtcatatggtttagaaccttgtaactttacgtatggtatacttattaatggctattgcaaaaataaaaggattgatgacgggcttattctgttcaaagagatgctgcgcaagggacttaaacctacaacttttaattataacgtcatactggatggattatttctggctggacaaactgttgctgcaaaagagaagtttgatgagatggttgaatctggagtaagtgtgtgcattgatacatactctatagttcttggtggactttgtagaaatagctgcagtagcgaagcgatcaccctgttctgaaacgcatccatggacgtggattgaattgaaggtgtactactgctgtgctggtccgtggatcgtggctgtcatgcatggtttgctgtgtcttctacgatatgtacttccctttgttccgtatatgtacatcttcctcgtttggttcatgtattttcctttgaataataataaataaatcgggctttccatatcggatgcttttatatctgtgtgtatggagattgtggtatatggtttcatctcaagttgtttacgtcaagaactaaagatatttcctcaaaaaaaaagaactaaagatataatcaatgtcattaacataactcatttccatgaggagaggacgaaggacgaagtcataataagtagattggttgatattttataatcattcaaaactgcaggggttataagatcttcattttgtagaagttttagatcttccgaggggttctc

SEQ ID NO: 3153 - DNA, 4083 bp, Triticum aestivum
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtctccaccatgcctcgcctctcctccaccacgccaatgtcaccaccacgcctccgcctccgactccgcggccgccactcctcctccacctctcatccctcacgcatctgggatccccacgccgccttcgccggcgcgacgcagcgggcgcactctggcaacctcaccccggaggacgcacaccacctgttcgacgaattgctgcggcagggcaatcctgtccaggagcgtcccttgactaactttctggctgccctcgcccgcgcgcccgcgtccgcatcctgcagcgatggccccgccctggccgtagccctcttcggtcgtttgtcccgaggcgccggacgacgcgtggcacagccaaatgtcttcacctatggcgtcctcatggactgctgctgccgcgcgtgccgcccggatctggcgctcgctttcttcggccgtctcttcaggaagggcctggaggcaaaccgagtcatcttctgcaccctcctcaagggactctgccacgcaaagcgcacagatgaggctctggacgtgctgcttcacaggatgcctgagctgggctgcacccccaacgtggtggcatataccacggtcatccacggcttctttaaggaaggccaagtaggcaaggcatgcaatctgttccatggaatggcgcagcagggcgttgcgcctaatttggtgacatataactcggttattgatgcgttgtgcaaggccaaagcaatggacaaggcagagtatttccttggtcagatggttgatgatggtgtcgtacctgataatgtgacatataatagcctcatccatggatattcctcttcaggccactggaaggaggcagttagggtattcaaagagatgacaagtcggagggttacagcagatgtgcatacttacaacatgtttatgacctttctttgcaaacatggaagaagcaaagaagctgcaggaatttttgataccatggctattaagggcctgaaacctgacaacgtttcatatgctattctccttcatgggtatgccaccgaaggatgcttagttgatatgattaatctcttcaattcaatggaaagagattgtattctacctgactgtcgtatcttcaacatactgattaatgcatatgctaaatctgggaagcttgataaggctatgcttatcttcaatgaaatgcagaaacaaggagtgagtccaaatgcagtcacatattcaaccgtaatacatacattttgcaaaaagggtaggttggatgatgctgtgataaagtttaatcagatgattgatacaggagtacgacagggcacagctgtttatggttctctaatccagggtttttgtacacacggcgatttggtgaaagcaaaggaattgcttactgaaatgatgaacaaaggtatgcttcctcctgatatcaagttcttccattcaatcatgcagaacctttgcacagaaggaagggtaatagaagcacgggatgtccttggcttgatagcgcacataggtatgaggcctgatgtttgcacatttaatatactgatcggtggatactgcctagtcggcaagatggaggatgcctcaaaaatatttgatgatatgatgtcatatggcttagaaccttctaattgttagaacgcatccatggacgtggattgaattgaaggtgtactactgctgtgctggtccgtggatcgtggctgtcatgcatggtttgctgtgtcttctacgatatgtacttccctttgttccgtatatgtacatcttcctcgtttggttcatgtattttcctttgaataataataaataaatcgggctttccatatcggatgcttttatatctgtgtgtatggagattgtggtatatggtttcatctcaagttgtttacgtcaagaactaaagatatttcctcaaaaaaaaagaactaaagatataatcaatgtcattaacataactcatttccatgaggagaggacgaaggacgaagtcataataagtagattggttgatattttataatcattcaaaactgcaggggttataagatcttcattttgtagaagttttagatcttccgaggggttctc

SEQ ID NO: 3154 - DNA, 2000 bp, Triticum aestivum
cgaagatggtgatgcgcggagctgggtcgcggcttgtccttctgatatcggcggttcggttcccctttgggtgcgtctgtgcttgtttctcactgtgacagagaagttgaagctacatgcggcgggggccctgcggcaatgatgactccatgagggtggcttcggcggacgatgctctccgcaggttgcactggactagcttggtgtgaggcttgcaactttctcctgtgatgctcatcaacaaaatcggagatgtcggtcctcgacgcctgcggccgatcgtttggcttggctgtcgaggtcctcgggtgccgtttgttcggaggggtcttgatgggtcgtcagcgaggaaatcggagttgcctgctcgtggagaggcgatgacgatgacattgcttgcagcctcgacggtgtcctctcgtcagcagtatgtgtgtgatcttgtcagtgccaggtcggccggagtgctctattcgatgggcgtgttttaattaaccgggcaactctcttcttcttaatcaatgaaaatggcaagtcttttacctcgtttcaaaaagagttaaatgcactggaggtcctaaaggtttcgtcggggtgtcactttagtcctatttcttccaaaatgcacctttaggtcctaattctttattaattggttcacccgaggtccttttccacgagcgctagctgaccagcacacgtgccgcattgacccacgccacatcgatagagggtctaaccgccaggcgagaagcttcgcaaagagaccccccccctcttagtggcaccctctctcctctttcacggtactttggcgacattggaggcgagcgacagaggcaaccggaggtgatctggaggtaatttgtgtgggtgcccgtgaagatgccccttctacgacggccagtgagcaatcctcctccatgttaccgtaagaaccctaatcttgtcgacgatcttctcctgtagctcttctaatatgtcataactttgccataatcaatagttgtagtccttgatttactttgatttgcataacggtgctacggacatggcaaaaaggacacaccaccagcggcaacatacccgccgaagttggagcttgcttcgccgcaccggcggcggtgctgaggatgttgccatgctcctcatcttagttgtttccttgccgaggagcttgaagttccggccatggataggtttagggaacgcgcgcgccgagagagagagcagatttggggaagaaataaagccagggactggggaatgagaagataatgtttataaggggttttctgtaaaaagaaagagcaacctacgcggcccttctgtcgatttggcatgggtcaacgcaccacacgagcaggtcaacgagcgctcgtgagaaaaaggacctagggtaaaccacttactaaagaattaggacctaaaggtgcattttggacgaaataagactaaagtgacaccctgacgaattttttaggaccttgagtgcatttaactctttcaaaaaataaagatgctaaaaaaactaaatgcttaaaaatacatttttctatgggaatacttaaaaatactagtataatttgatggcttcctagtatatttctagcgcttacaactaaatttatattcttggtctaaataaaattataatctgataaattatgtgatatgtatatagccatatgagaccataatttaattttacctgcaaaaagtaagtaatagtaatagtagtactacatactccctccgtccgaaaatacttgtcgaagaatttgatgaaaatggatgcatctagaacaagaatacatctagatacatcaatctccccgacaagtatttccgaacggagggagtactagataataagataactatccaaaaaaaaaaagataactgaaggttgccacctagcacattcacattggtacaacttggaaaagcacagccccgtcgtcctgctcccagttgagttcgcgacctacacaccggcc

SEQ ID NO: 3155 - DNA, 2000 bp, Triticum aestivum
tttcggcggacgatgctctccgcaggttgcactggactagcttggtgtgaggcttgcaactttctcctgtgatgctcatcaacaaaatcggagatgtcggtcctcgacgcctgcggccgatcatttggcttggctgtcgaggtcctcgggtgccgtttgttcggaggggtcttgatgggtcgtcagcgaggaaatcggagttgcctgctcgtggagaggcgatgacgatgacattgcagcctcgacggtgtcctctcgtcagcagtatgtgtgtgatcttgtcagtgccaggtcggctggagtgccctattcgatgggcgtgttttaattaaccgggcaactctcttcttcttaatcagtgaaaatggcaagtcttttacctcgtttcaaaaagagttaaatgcactggaggtcctaaaggtttcgtcggggtgtcactttagtcctatttcttccaaaatgcacctttaggtcctaattctttattaattggttcacccgaggtccttttccacgagcgctcgctgaccagcacacgtgccgcattgacccatgccacatcgatagagggtctaaccgccaggcgagaagcttcgcaaagagacccccccccctcttagtggcaccctctctcctctttcacggtactttggcgacattggaggcgagcgacagaggcaaccggaggtgatctggaggtaatttgtgtgggtgcccgtgaagatgccccttctatgacggccagtgagcaatcctcctccatgttaccgtaagaaccctaatcttgtcgatgatcttctcctgtagctcttctaatatgtcataactttgtcataatcaatagttgtagtccttgatttactttgatttgcataacggtgatacggacacggcaaaaaggacacaccaccagcggcaacatacccgccgaagttggagcttgcttcgccgcgccggcggcggtgctgaggatgttgccatgctcctcatcttagttgtttccttgccgaggagcttgaagttccggccatggataggtttaggggacgcgcgcgccgagagagagagcagatttggggaagaaataaagccagggactggggaatgagaagataatgtttataaggggttttctgtaaaaagaaagagcaacctacgcagcccttctgtcgatttggcatgggtcaacgcaccacacgagcaggtcaacgagcgctcgtgagaaaaaggacctagggtaaaccacttactaaagaattaggacctaaaggtgcattttggacgaaataagactaaagtgacaccctgacgaattttttaggaccttgagtgcatttaactctttcaaaaaataaagatgctaaaaaaactaaatgcttaaaaatacatttttctatgggaatacttaaaaatactagtataatttgatggcttcctagtatatttctagggcttacaactaaatttatattcttggtctaaataaaattataatctgataaattatgtgatatgaatatagccatatgagaccataatttaattttacctgcaaaaagtaagtaatagtagtagtagtactacatactccctccgtccggaaatacttgtcgaagaatttgatgaaaatggatgcatctagaacaagaatacatctagatacatcaatctccctgacaagtatttccgagcggagggagtactagataatactccctccgttcctaaataattgtctttctagctatctcaaataaactacaacatacggatgtatgtagacatgttttagagtgtagattcactcattttgttccgtatgtagtcatttgttgaaatctctagagagacaattatttaggaacggagggagtaagataactaccctaaaaaaaaagataactgaaggttgccacctagcacattcacattggtacaacttggaaaagcacagccccgtcgtcctgctcccagttgagttcgcgacctacacaccggcc

SEQ ID NO: 3156 - DNA, 4817 bp, Triticum aestivum
cgaagatggtgatgcgcggagctgggtcgcggcttgtccttctgatatcggcggttcggttcccctttgggtgcgtctgtgcttgtttctcactgtgacagagaagttgaagctacatgcggcgggggccctgcggcaatgatgactccatgagggtggcttcggcggacgatgctctccgcaggttgcactggactagcttggtgtgaggcttgcaactttctcctgtgatgctcatcaacaaaatcggagatgtcggtcctcgacgcctgcggccgatcgtttggcttggctgtcgaggtcctcgggtgccgtttgttcggaggggtcttgatgggtcgtcagcgaggaaatcggagttgcctgctcgtggagaggcgatgacgatgacattgcttgcagcctcgacggtgtcctctcgtcagcagtatgtgtgtgatcttgtcagtgccaggtcggccggagtgctctattcgatgggcgtgttttaattaaccgggcaactctcttcttcttaatcaatgaaaatggcaagtcttttacctcgtttcaaaaagagttaaatgcactggaggtcctaaaggtttcgtcggggtgtcactttagtcctatttcttccaaaatgcacctttaggtcctaattctttattaattggttcacccgaggtccttttccacgagcgctagctgaccagcacacgtgccgcattgacccacgccacatcgatagagggtctaaccgccaggcgagaagcttcgcaaagagaccccccccctcttagtggcaccctctctcctctttcacggtactttggcgacattggaggcgagcgacagaggcaaccggaggtgatctggaggtaatttgtgtgggtgcccgtgaagatgccccttctacgacggccagtgagcaatcctcctccatgttaccgtaagaaccctaatcttgtcgacgatcttctcctgtagctcttctaatatgtcataactttgccataatcaatagttgtagtccttgatttactttgatttgcataacggtgctacggacatggcaaaaaggacacaccaccagcggcaacatacccgccgaagttggagcttgcttcgccgcaccggcggcggtgctgaggatgttgccatgctcctcatcttagttgtttccttgccgaggagcttgaagttccggccatggataggtttagggaacgcgcgcgccgagagagagagcagatttggggaagaaataaagccagggactggggaatgagaagataatgtttataaggggttttctgtaaaaagaaagagcaacctacgcggcccttctgtcgatttggcatgggtcaacgcaccacacgagcaggtcaacgagcgctcgtgagaaaaaggacctagggtaaaccacttactaaagaattaggacctaaaggtgcattttggacgaaataagactaaagtgacaccctgacgaattttttaggaccttgagtgcatttaactctttcaaaaaataaagatgctaaaaaaactaaatgcttaaaaatacatttttctatgggaatacttaaaaatactagtataatttgatggcttcctagtatatttctagcgcttacaactaaatttatattcttggtctaaataaaattataatctgataaattatgtgatatgtatatagccatatgagaccataatttaattttacctgcaaaaagtaagtaatagtaatagtagtactacatactccctccgtccgaaaatacttgtcgaagaatttgatgaaaatggatgcatctagaacaagaatacatctagatacatcaatctccccgacaagtatttccgaacggagggagtactagataataagataactatccaaaaaaaaaaagataactgaaggttgccacctagcacattcacattggtacaacttggaaaagcacagccccgtcgtcctgctcccagttgagttcgcgacctacacaccggccatgccccgcttctcctccaccacgccaatgtcgccaccccgcctccgcctccgactctgcgcccgccactcctcctccacctctcatccctcacgcatctgggatccccacgccgccttcgccgccgcggcacagcgggcgagctctggcacgctcactacggaggacgcacaccacctgtttgacgaattgctgcggcggggcaatcctgtccaggagcgtcccttgaataaatttctggctgccctcgcccgcgcgcccgcgtccgcatcctgctgcgatggccccgccctggcagtcgccctcttcggccgtttgtcccgagacgtcggacgacgggtggcgcagccaaatgtcttcacctatggcgtcctcatggactgctgctgccgcgcttgccgcacagatctggtgctcgccttctttggccgtctcctcaagacgggcctggaggcaaaccaagtcgtcttcaacaccctcctcaagggcctttgccacacaaagcgggcggatgaggctctggacgtgctgcttcacaggatgcctgagctgggctgcactcctaatgtggtggcgtataacaccgttatccatggcttctttaaggaaggccatgtaagcaaggcctgcaatctgttccatgaaatggcgcagcagggcgttaagcctaatgtggtgacatataactcagttatcgatgcgctgtgcaaggccagagccatggacaaggcagaggtggtccttcgtcagatgattgatgatggtgttggacctgataatgtgacgtatagtagcctcatccatggatattcctcttcaggccactggaaggaggcagttagggtattcaaagagatgacaagtcggagggttacagcagatgtgcatacttacaacatgtttatgacctttctttgcaaacatggaagaagcaaagaagctgcaggaatttttgataccatggctatcaagggcctgaaacctgacaacgtttcatatgctattctccttcatgggtatgccgccgaaggatgcttagttgatatgattaatctcttcaattcaatggaaagagattgtattctacctgactgtcgtatcttcaacatactgattaatgcatatgctaaatctgggaagcttgataaggctatgcttatcttcaatgaaatgcagaaacaaggagtgagtccaaatgcagtcacatattcaaccgtaatacatgcattttgcaagaagggtaggttggatgatgctgtgataaagtttaatcagatgattgatacaggagtacgaccggacgcatctgtttatcgtcccctaatccagggtttttgtacacatggcgatttggtgaaagcaaaggaatatgttactgaaatgatgaagaaaggtatgcctcctcctgatattatgttcttcagttcaatcatgcagaacctatgcacagaaggaagggtaacagaagcacgggatatccttgacttgatagtgcacattggtatgaggcctaatgttatcatatttaatttgctgatcggtggatactgcctagtccgcaagatggcagatgcattgaaagtatttgatgatatggtgtcatatggtttagaaccttgtaactttacgtatggtatacttattaatggctattgcaaaaatagaaggattgatgacgggcttattctgttcaaagagatgctgcacaagggacttaaacctacaacttttaattataacgtcatactggatggattatttctggctggacaaactgttgctgcaaaagagaagtttgatgagatggttgaatctggagtaagtgtgtgcattgatacatactctataattcttggtggactttgtagaaatagctgcagtagcgaagcgatcacccttttccggaaattaagcgcaatgaatgtgaaatttgatattacaattgtcaatatcattattggtgccttatacagggtcgagagaaaccaagaggctaaggatttgtttgctgctatgccagccaatggcttggttcctaatgctgttacctacaccgtaatgatgacaaatcttataaaagaaggttcagtggaagaagctgacaatcttttcttatccatggagaagagcggctgtactgccaactcttgcctgttaaatcatatcatcagaaggttactggaaaaaggagagatagtcaaggctggaaattatatgtctaaagttgatgcaaagagctactcacttgaagctaaaactgtttcgctgctgatctctctgttttcaaggaaagggaaatatagagaacacatcaaattgcttcctacaaagtatcagtttctggaagaagcagccacagttgaataggcatccatggacgtggattgaattgaaggtgtactactgctgtgctggtccgtggatcgtggctgtcatgcatggtttgctgtgtcttctacgatatgtacttccctttgttccgtatatgtacatcttcctcgtttggttcatgtattttcctttgaataataataaataaatcgggctttccatatcggatgcttttatatctgtgtgtatggagattgtggtatatggtttcatctcaagttgtttacgtcaagaactaaagatatttcctcaaaaaaaaagaactaaagatataatcaatgtcattaacataactcatttccatgaggagaggacgaaggacgaagtcataataagtagattggttgatattttataatcattcaaaactgcaggggttataagatcttcattttgtagaagttttagatcttccgaggggttctc

SEQ ID NO: 3157 - DNA, 4823 bp, Triticum aestivum
tttcggcggacgatgctctccgcaggttgcactggactagcttggtgtgaggcttgcaactttctcctgtgatgctcatcaacaaaatcggagatgtcggtcctcgacgcctgcggccgatcatttggcttggctgtcgaggtcctcgggtgccgtttgttcggaggggtcttgatgggtcgtcagcgaggaaatcggagttgcctgctcgtggagaggcgatgacgatgacattgcagcctcgacggtgtcctctcgtcagcagtatgtgtgtgatcttgtcagtgccaggtcggctggagtgccctattcgatgggcgtgttttaattaaccgggcaactctcttcttcttaatcagtgaaaatggcaagtcttttacctcgtttcaaaaagagttaaatgcactggaggtcctaaaggtttcgtcggggtgtcactttagtcctatttcttccaaaatgcacctttaggtcctaattctttattaattggttcacccgaggtccttttccacgagcgctcgctgaccagcacacgtgccgcattgacccatgccacatcgatagagggtctaaccgccaggcgagaagcttcgcaaagagacccccccccctcttagtggcaccctctctcctctttcacggtactttggcgacattggaggcgagcgacagaggcaaccggaggtgatctggaggtaatttgtgtgggtgcccgtgaagatgccccttctatgacggccagtgagcaatcctcctccatgttaccgtaagaaccctaatcttgtcgatgatcttctcctgtagctcttctaatatgtcataactttgtcataatcaatagttgtagtccttgatttactttgatttgcataacggtgatacggacacggcaaaaaggacacaccaccagcggcaacatacccgccgaagttggagcttgcttcgccgcgccggcggcggtgctgaggatgttgccatgctcctcatcttagttgtttccttgccgaggagcttgaagttccggccatggataggtttaggggacgcgcgcgccgagagagagagcagatttggggaagaaataaagccagggactggggaatgagaagataatgtttataaggggttttctgtaaaaagaaagagcaacctacgcagcccttctgtcgatttggcatgggtcaacgcaccacacgagcaggtcaacgagcgctcgtgagaaaaaggacctagggtaaaccacttactaaagaattaggacctaaaggtgcattttggacgaaataagactaaagtgacaccctgacgaattttttaggaccttgagtgcatttaactctttcaaaaaataaagatgctaaaaaaactaaatgcttaaaaatacatttttctatgggaatacttaaaaatactagtataatttgatggcttcctagtatatttctagggcttacaactaaatttatattcttggtctaaataaaattataatctgataaattatgtgatatgaatatagccatatgagaccataatttaattttacctgcaaaaagtaagtaatagtagtagtagtactacatactccctccgtccggaaatacttgtcgaagaatttgatgaaaatggatgcatctagaacaagaatacatctagatacatcaatctccctgacaagtatttccgagcggagggagtactagataatactccctccgttcctaaataattgtctttctagctatctcaaataaactacaacatacggatgtatgtagacatgttttagagtgtagattcactcattttgttccgtatgtagtcatttgttgaaatctctagagagacaattatttaggaacggagggagtaagataactaccctaaaaaaaaagataactgaaggttgccacctagcacattcacattggtacaacttggaaaagcacagccccgtcgtcctgctcccagttgagttcgcgacctacacaccggccatgccccgcttctcctccaccacgccaatgtcgccaccccgcctccgcctccgcctccgactctgcgcccgccactcctcctccacctctcatccctcacgcatctgggatccccacgccgccttcgccgccgcggcacagcgggcgagctctggcacgctcactacggaggacgcacaccacctgtttgacgaattgctgcggcggggcaatcctgtccaggagcgtcccttgaataaatttctggctgccctcgcccgcgcgcccgcgtccgcatcctgctgcgatggccccgccctggcagtcaccctcttcggccgtttgtcccgagacgtcggacgacgggtggcgcagccaaatgtcttcacctatggcgtcctcatggactgctgctgccgcgcttgccgcacagatctggtgctcgccttctttggccgtctcctcaagacgggcctggaggcaaaccaagtcgtcttcaacaccctcctcaagggcctttgccacacaaagcgggcggatgaggctctggacgtgctgcttcacaggatgcctgagctgggctgcactcctaatgtggtggcgtataacaccgttatccatggcttctttaaggaaggccatgtaagcaaggcctgcaatctgttccatgaaatggcgcagcagggcgttaagcctaatgtggtgacatataactcagttattgatgcgctgtgcaaggccagagccatggacaaggcagaggtggtccttcgtcagatgattgatgatggtgttggacctgataatgtgacgtatagtagcctcatccatggatattcctcttcaggccactggaaggaggcagttagggtattcaaagagatgacaagtcggagggttacagcagatgtgcatacttacaacatgtttatgacctttctttgcaaacatggaagaagcaaagaagctgcaggaatttttgataccatggctatcaagggcctgaaacctgacaacgtttcatatgctattcgccttcatgggtatgccaccgaaggatgcctagttgacatgatcaatctcttcaattccatggcaacacactgcattctacctaactgtcatatattcaacatactgattaatgcatatgctaaatctgggaagcttgataaggctatgcttatcttcaatgaaatgcagaaacaaggagtgagtccaaatgcagtcacatattcaaccgtaatacatgcattttgcaagaagggtaggttggatgatgctgtgataaagtttaatcagatgattgatacaggagtacgaccggacgcatctgtttatcgtcccctaatccagggtttttgtacacatggcgatttggtgaaagcaaaggaatatgttactgaaatgatgaagaaaggtatgcctcctcctgatattatgttcttcagttcaatcatgcagaacctatgcacagaaggaagggtaacagaagcacgggatatccttgacttgatagtgcacattggtatgaggcctaatgttatcatatttaatttgctgatcggtggatactgcctagtccgcaagatggcagatgcattgaaagtatttgatgatatggtgtcatatggtttagaaccttgtaactttacgtatggtatacttattaatggctattgcaaaaatagaaggattgatgacgggcttattctgttcaaagagatgctgcacaagggacttaaacctacaacttttaattataacgtcatactggatggattatttctggctggacaaactgttgctgcaaaagagaagtttgatgagatggttgaatctggagtaagtgtgtgcattgatacatactctataattcttggtggactttgtagaaatagctgcagtagcgaagcgatcacccttttccggaaattaagcgcaatgaatgtgaaatttgatattacaattgtcaatatcattattggtgccttatacagggtcgagagaaaccaagaggctaaggatttgtttgctgctatgccagccaatggcttggttcctaatgctgttacctacaccgtaatgatgacaaatcttataaaagaaggttcagtggaagaagctgacaatcttttcttatccatggagaagagcggctgtactgccaactcttgcctgttaaatcatatcatcagaaggttactggaaaaaggagagatagtcaaggctggaaattatatgtctaaagttgatgcaaagagctactcacttgaagctaaaactgtttcgctgctgatctctctgttttcaaggaaagggaaatatagagaacacatcaaattgcttcctacaaagtatcagtttctggaagaagcagccacagttgaataggcatccatggacgtggattgaattgaaggtgtactactgctgtgctggtccgtggatcgtggctgtcatgcatggtttgctgtgtcttctacgatatgtacttccctttgttccgtatatgtacatcttcctcgtttggttcatgtattttcctttgaataataataaataaatcgggctttccatatcggatgcttttatatctgtgtgtatggagattgtggtatatggtttcatctcaagttgtttacgtcaagaactaaagatatttcctcaaaaaaaaagaactaaagatataatcaatgtcattaacataactcatttccatgaggagaggacgaaggacgaagtcataataagtagattggttgatattttataatcattcaaaactgcaggggttataagatcttcattttgtagaagttttagatcttccgaggggttctc

SEQ ID NO: 3158 - DNA, 5179 bp, Triticum aestivum
cgaagatggtgatgcgcggagctgggtcgcggcttgtccttctgatatcggcggttcggttcccctttgggtgcgtctgtgcttgtttctcactgtgacagagaagttgaagctacatgcggcgggggccctgcggcaatgatgactccatgagggtggcttcggcggacgatgctctccgcaggttgcactggactagcttggtgtgaggcttgcaactttctcctgtgatgctcatcaacaaaatcggagatgtcggtcctcgacgcctgcggccgatcgtttggcttggctgtcgaggtcctcgggtgccgtttgttcggaggggtcttgatgggtcgtcagcgaggaaatcggagttgcctgctcgtggagaggcgatgacgatgacattgcttgcagcctcgacggtgtcctctcgtcagcagtatgtgtgtgatcttgtcagtgccaggtcggccggagtgctctattcgatgggcgtgttttaattaaccgggcaactctcttcttcttaatcaatgaaaatggcaagtcttttacctcgtttcaaaaagagttaaatgcactggaggtcctaaaggtttcgtcggggtgtcactttagtcctatttcttccaaaatgcacctttaggtcctaattctttattaattggttcacccgaggtccttttccacgagcgctagctgaccagcacacgtgccgcattgacccacgccacatcgatagagggtctaaccgccaggcgagaagcttcgcaaagagaccccccccctcttagtggcaccctctctcctctttcacggtactttggcgacattggaggcgagcgacagaggcaaccggaggtgatctggaggtaatttgtgtgggtgcccgtgaagatgccccttctacgacggccagtgagcaatcctcctccatgttaccgtaagaaccctaatcttgtcgacgatcttctcctgtagctcttctaatatgtcataactttgccataatcaatagttgtagtccttgatttactttgatttgcataacggtgctacggacatggcaaaaaggacacaccaccagcggcaacatacccgccgaagttggagcttgcttcgccgcaccggcggcggtgctgaggatgttgccatgctcctcatcttagttgtttccttgccgaggagcttgaagttccggccatggataggtttagggaacgcgcgcgccgagagagagagcagatttggggaagaaataaagccagggactggggaatgagaagataatgtttataaggggttttctgtaaaaagaaagagcaacctacgcggcccttctgtcgatttggcatgggtcaacgcaccacacgagcaggtcaacgagcgctcgtgagaaaaaggacctagggtaaaccacttactaaagaattaggacctaaaggtgcattttggacgaaataagactaaagtgacaccctgacgaattttttaggaccttgagtgcatttaactctttcaaaaaataaagatgctaaaaaaactaaatgcttaaaaatacatttttctatgggaatacttaaaaatactagtataatttgatggcttcctagtatatttctagcgcttacaactaaatttatattcttggtctaaataaaattataatctgataaattatgtgatatgtatatagccatatgagaccataatttaattttacctgcaaaaagtaagtaatagtaatagtagtactacatactccctccgtccgaaaatacttgtcgaagaatttgatgaaaatggatgcatctagaacaagaatacatctagatacatcaatctccccgacaagtatttccgaacggagggagtactagataataagataactatccaaaaaaaaaaagataactgaaggttgccacctagcacattcacattggtacaacttggaaaagcacagccccgtcgtcctgctcccagttgagttcgcgacctacacaccggccatgccccgcttctcctccaccacgccaatgtcgccaccccgcctccgcctccgactctgcgcccgccactcctcctccacctctcatccctcacgcatctgggatccccacgccgccttcgccgccgcggcacagcgggcgagctctggcacgctcactacggaggacgcacaccacctgtttgacgaattgctgcggcggggcaatcctgtccaggagcgtcccttgaataaatttctggctgccctcgcccgcgcgcccgcgtccgcatcctgctgcgatggccccgccctggcagtcgccctcttcggccgtttgtcccgagacgtcggacgacgggtggcgcagccaaatgtcttcacctatggcgtcctcatggactgctgctgccgcgcttgccgcacagatctggtgctcgccttctttggccgtctcctcaagacgggcctggaggcaaaccaagtcgtcttcaacaccctcctcaagggcctttgccacacaaagcgggcggatgaggctctggacgtgctgcttcacaggatgcctgagctgggctgcactcctaatgtggtggcgtataacaccgttatccatggcttctttaaggaaggccatgtaagcaaggcctgcaatctgttccatgaaatggcgcagcagggcgttaagcctaatgtggtgacatataactcagttatcgatgcgctgtgcaaggccagagccatggacaaggcagaggtggtccttcgtcagatgattgatgatggtgttggacctgataatgtgacgtatagtagcctcatccatggatattcctcttcaggccactggaaggaggcagttagggtattcaaagagatgacaagtcggagggttacagcagatgtgcatacttacaacatgtttatgacctttctttgcaaacatggaagaagcaaagaagctgcaggaatttttgataccatggctatcaagggcctgaaacctgacaacgtttcatatgctattctccttcatgggtatgccgccgaaggatgcttagttgatatgattaatctcttcaattcaatggaaagagattgtattctacctgactgtcgtatcttcaacatactgattaatgcatatgctaaatctgggaagcttgataaggctatgcttatcttcaatgaaatgcagaaacaaggagtgagtccaaatgcagtcacatattcaaccgtaatacatgcattttgcaagaagggtaggttggatgatgctgtgataaagtttaatcagatgattgatacaggagtacgaccggacgcatctgtttatcgtcccctaatccagggtttttgtacacatggcgatttggtgaaagcaaaggaatatgttactgaaatgatgaagaaaggtatgcctcctcctgatattatgttcttcagttcaatcatgcagaacctatgcacagaaggaagggtaacagaagcacgggatatccttgacttgatagtgcacattggtatgaggcctaatgttatcatatttaatttgctgatcggtggatactgcctagtccgcaagatggcagatgcattgaaagtatttgatgatatggtgtcatatggtttagaaccttgtaactttacgtatggtatacttattaatggctattgcaaaaatagaaggattgatgacgggcttattctgttcaaagagatgctgcacaagggacttaaacctacaacttttaattataacgtcatactggatggattatttctggctggacaaactgttgctgcaaaagagaagtttgatgagatggttgaatctggagtaagtgtgtgcattgatacatactctataattcttggtggactttgtagaaatagctgcagtagcgaagcgatcacccttttccggaaattaagcgcaatgaatgtgaaatttgatattacaattgtcaatatcattattggtgccttatacagggtcgagagaaaccaagaggctaaggatttgtttgctgctatgccagccaatggcttggttcctaatgctgttacctacaccgtaatgatgacaaatcttataaaagaaggttcagtggaagaagctgacaatcttttcttatccatggagaagagcggctgtactgccaactcttgcctgttaaatcatatcatcagaaggttactggaaaaaggagagatagtcaaggctggaaattatatgtctaaagttgatgcaaagagctactcacttgaagctaaaactgtttcgctgctgatctctctgttttcaaggaaagggaaatatagagaacacatcaaattgcttcctacaaagtatcagtttctggaagaagcagccacagttgaatagttggtacatgatatctgaaatttaatttgcatcgcttgccatgggtccgtctgcttgtacaagaaatgcattttctatttgtaaataggaagtcagtttagaacaagccatcaggatgacgcaaagagtacaattcagttgcaccaccaataaaaaggcagaactagggctgccaaaacaacactgaatcaaaactcaaacagaaggagcagcaaacttttttttttttgaagctggacagtctgctagccaaacaactacaggagactgtcaggcggggcatgtagtggctggcgtctaagcgcctttgcttcttccaccatccatggcttagcctcacacggaatcgagtcaaccaattcccgtcggttttgggtggctcccttgaagatgcaattgttttcagcggccagatacgcatggtcagattaatcagcgagtgtgccccttctgtctggttcgagaaagaatttgaagagctgagcttgtccctgctggaaccagtttgaggttagttaatcataacagggtactagagaggtgttttattgactgttgatgtgtaatatgttatatgccatcctcttgatgattacggtgatctgtgaagaggcagcatgcaaaagtctgaatcacatatgcttatgtaattgtgttattatttgtgcagcttctagaccttttgccttgtagatggctacatggatctagttgtagcaatctgtaactgttagtgttttgtatatgctggcattgatgattagggtgacttgtgaagcatgcagaagtctgaatcgtacatgcttgtctag

SEQ ID NO: 3159 - DNA, 5201 bp, Triticum aestivum
tttcggcggacgatgctctccgcaggttgcactggactagcttggtgtgaggcttgcaactttctcctgtgatgctcatcaacaaaatcggagatgtcggtcctcgacgcctgcggccgatcatttggcttggctgtcgaggtcctcgggtgccgtttgttcggaggggtcttgatgggtcgtcagcgaggaaatcggagttgcctgctcgtggagaggcgatgacgatgacattgcagcctcgacggtgtcctctcgtcagcagtatgtgtgtgatcttgtcagtgccaggtcggctggagtgccctattcgatgggcgtgttttaattaaccgggcaactctcttcttcttaatcagtgaaaatggcaagtcttttacctcgtttcaaaaagagttaaatgcactggaggtcctaaaggtttcgtcggggtgtcactttagtcctatttcttccaaaatgcacctttaggtcctaattctttattaattggttcacccgaggtccttttccacgagcgctcgctgaccagcacacgtgccgcattgacccatgccacatcgatagagggtctaaccgccaggcgagaagcttcgcaaagagacccccccccctcttagtggcaccctctctcctctttcacggtactttggcgacattggaggcgagcgacagaggcaaccggaggtgatctggaggtaatttgtgtgggtgcccgtgaagatgccccttctatgacggccagtgagcaatcctcctccatgttaccgtaagaaccctaatcttgtcgatgatcttctcctgtagctcttctaatatgtcataactttgtcataatcaatagttgtagtccttgatttactttgatttgcataacggtgatacggacacggcaaaaaggacacaccaccagcggcaacatacccgccgaagttggagcttgcttcgccgcgccggcggcggtgctgaggatgttgccatgctcctcatcttagttgtttccttgccgaggagcttgaagttccggccatggataggtttaggggacgcgcgcgccgagagagagagcagatttggggaagaaataaagccagggactggggaatgagaagataatgtttataaggggttttctgtaaaaagaaagagcaacctacgcagcccttctgtcgatttggcatgggtcaacgcaccacacgagcaggtcaacgagcgctcgtgagaaaaaggacctagggtaaaccacttactaaagaattaggacctaaaggtgcattttggacgaaataagactaaagtgacaccctgacgaattttttaggaccttgagtgcatttaactctttcaaaaaataaagatgctaaaaaaactaaatgcttaaaaatacatttttctatgggaatacttaaaaatactagtataatttgatggcttcctagtatatttctagggcttacaactaaatttatattcttggtctaaataaaattataatctgataaattatgtgatatgaatatagccatatgagaccataatttaattttacctgcaaaaagtaagtaatagtagtagtagtactacatactccctccgtccggaaatacttgtcgaagaatttgatgaaaatggatgcatctagaacaagaatacatctagatacatcaatctccctgacaagtatttccgagcggagggagtactagataatactccctccgttcctaaataattgtctttctagctatctcaaataaactacaacatacggatgtatgtagacatgttttagagtgtagattcactcattttgttccgtatgtagtcatttgttgaaatctctagagagacaattatttaggaacggagggagtaagataactaccctaaaaaaaaagataactgaaggttgccacctagcacattcacattggtacaacttggaaaagcacagccccgtcgtcctgctcccagttgagttcgcgacctacacaccggccatgccccgcttctcctccaccacgccaatgtcgccaccccgcctccgcctccgcctccgactctgcgcccgccactcctcctccacctctcatccctcacgcatctgggatccccacgccgccttcgccgccgcggcacagcgggcgagctctggcacgctcactacggaggacgcacaccacctgtttgacgaattgctgcggcggggcaatcctgtccaggagcgtcccttgaataaatttctggctgccctcgcccgcgcgcccgcgtccgcatcctgctgcgatggccccgccctggcagtcaccctcttcggccgtttgtcccgagacgtcggacgacgggtggcgcagccaaatgtcttcacctatggcgtcctcatggactgctgctgccgcgcttgccgcacagatctggtgctcgccttctttggccgtctcctcaagacgggcctggaggcaaaccaagtcgtcttcaacaccctcctcaagggcctttgccacacaaagcgggcggatgaggctctggacgtgctgcttcacaggatgcctgagctgggctgcactcctaatgtggtggcgtataacaccgttatccatggcttctttaaggaaggccatgtaagcaaggcctgcaatctgttccatgaaatggcgcagcagggcgttaagcctaatgtggtgacatataactcagttattgatgcgctgtgcaaggccagagccatggacaaggcagaggtggtccttcgtcagatgattgatgatggtgttggacctgataatgtgacgtatagtagcctcatccatggatattcctcttcaggccactggaaggaggcagttagggtattcaaagagatgacaagtcggagggttacagcagatgtgcatacttacaacatgtttatgacctttctttgcaaacatggaagaagcaaagaagctgcaggaatttttgataccatggctatcaagggcctgaaacctgacaacgtttcatatgctattcgccttcatgggtatgccaccgaaggatgcctagttgacatgatcaatctcttcaattccatggcaacacactgcattctacctaactgtcatatattcaacatactgattaatgcatatgctaaatctgggaagcttgataaggctatgcttatcttcaatgaaatgcagaaacaaggagtgagtccaaatgcagtcacatattcaaccgtaatacatgcattttgcaagaagggtaggttggatgatgctgtgataaagtttaatcagatgattgatacaggagtacgaccggacgcatctgtttatcgtcccctaatccagggtttttgtacacatggcgatttggtgaaagcaaaggaatatgttactgaaatgatgaagaaaggtatgcctcctcctgatattatgttcttcagttcaatcatgcagaacctatgcacagaaggaagggtaacagaagcacgggatatccttgacttgatagtgcacattggtatgaggcctaatgttatcatatttaatttgctgatcggtggatactgcctagtccgcaagatggcagatgcattgaaagtatttgatgatatggtgtcatatggtttagaaccttgtaactttacgtatggtatacttattaatggctattgcaaaaatagaaggattgatgacgggcttattctgttcaaagagatgctgcacaagggacttaaacctacaacttttaattataacgtcatactggatggattatttctggctggacaaactgttgctgcaaaagagaagtttgatgagatggttgaatctggagtaagtgtgtgcattgatacatactctataattcttggtggactttgtagaaatagctgcagtagcgaagcgatcacccttttccggaaattaagcgcaatgaatgtgaaatttgatattacaattgtcaatatcattattggtgccttatacagggtcgagagaaaccaagaggctaaggatttgtttgctgctatgccagccaatggcttggttcctaatgctgttacctacaccgtaatgatgacaaatcttataaaagaaggttcagtggaagaagctgacaatcttttcttatccatggagaagagcggctgtactgccaactcttgcctgttaaatcatatcatcagaaggttactggaaaaaggagagatagtcaaggctggaaattatatgtctaaagttgatgcaaagagctactcacttgaagctaaaactgtttcgctgctgatctctctgttttcaaggaaagggaaatatagagaacacatcaaattgcttcctacaaagtatcagtttctggaagaagcagccacagttgaatagttggtacatgatatctgaaatttaatttgcatcgcttgccatgggtccgtctgcttgtacaagaaatgcattttctatttgtaaataggaagtcagtttagaacaagccatcaggatgacgcaaagagtacaattcagttgcaccaccaataaaaaggcagaactagggctgccaaaacaacactgaatcaaaactcaaacagaaggagcagcaaacttttttttttgaagctggacagtctgctagccaaacaactacaggagactgtcaggcggggcatgtagtggctggcgtctaagcgcctttgcttcttccaccatccatggcttagcctcacacggaatcgagtcaaccaattcccgtcggttttgggtggctcccttgaagatgcaattgttttcagcggccagatacgcatggtcagattaatcagcgagtgtgccccttctgtctggttcgagaaagaatttgaagagctgagcttgtcccagctggaaccagtttgaggttagttaatcataacagggtactagagaggtgttttattgactgttgatgtgtaatatgttatatgccatcctcttgatgattacggtgatctgtgaagaggcagcatgcaaaagtctgaatcacatatgcttatgtaattgtgttattatttgtgcagcttctagaccttttgccttgtagatggctacatggatctagttgtagcaatctgtaactgttagtgttttgtatatgctggcattgatgattagggtgacttgtgaagcatgcagaagtctgaatcatacatgcttgtctagttatttttggggctctct

SEQ ID NO: 3160 - DNA, 812 bp, Triticum aestivum
ttggtacatgatatctgaaatttaatttgcatcgcttgccatgggtccgtctgcttgtacaagaaatgcattttctatttgtaaataggaagtcagtttagaacaagccatcaggatgacgcaaagagtacaattcagttgcaccaccaataaaaaggcagaactagggctgccaaaacaacactgaatcaaaactcaaacagaaggagcagcaaacttttttttttttgaagctggacagtctgctagccaaacaactacaggagactgtcaggcggggcatgtagtggctggcgtctaagcgcctttgcttcttccaccatccatggcttagcctcacacggaatcgagtcaaccaattcccgtcggttttgggtggctcccttgaagatgcaattgttttcagcggccagatacgcatggtcagattaatcagcgagtgtgccccttctgtctggttcgagaaagaatttgaagagctgagcttgtccctgctggaaccagtttgaggttagttaatcataacagggtactagagaggtgttttattgactgttgatgtgtaatatgttatatgccatcctcttgatgattacggtgatctgtgaagaggcagcatgcaaaagtctgaatcacatatgcttatgtaattgtgttattatttgtgcagcttctagaccttttgccttgtagatggctacatggatctagttgtagcaatctgtaactgttagtgttttgtatatgctggcattgatgattagggtgacttgtgaagcatgcagaagtctgaatcgtacatgcttgtctag

SEQ ID NO: 3161 - DNA, 828 bp, Triticum aestivum
ttggtacatgatatctgaaatttaatttgcatcgcttgccatgggtccgtctgcttgtacaagaaatgcattttctatttgtaaataggaagtcagtttagaacaagccatcaggatgacgcaaagagtacaattcagttgcaccaccaataaaaaggcagaactagggctgccaaaacaacactgaatcaaaactcaaacagaaggagcagcaaacttttttttttgaagctggacagtctgctagccaaacaactacaggagactgtcaggcggggcatgtagtggctggcgtctaagcgcctttgcttcttccaccatccatggcttagcctcacacggaatcgagtcaaccaattcccgtcggttttgggtggctcccttgaagatgcaattgttttcagcggccagatacgcatggtcagattaatcagcgagtgtgccccttctgtctggttcgagaaagaatttgaagagctgagcttgtcccagctggaaccagtttgaggttagttaatcataacagggtactagagaggtgttttattgactgttgatgtgtaatatgttatatgccatcctcttgatgattacggtgatctgtgaagaggcagcatgcaaaagtctgaatcacatatgcttatgtaattgtgttattatttgtgcagcttctagaccttttgccttgtagatggctacatggatctagttgtagcaatctgtaactgttagtgttttgtatatgctggcattgatgattagggtgacttgtgaagcatgcagaagtctgaatcatacatgcttgtctagttatttttggggctctct

SEQ ID NO: 3162 - DNA, 1837 bp, Triticum aestivum
tttcggcggacgatgctctccgcaggttgcactggactagcttggtgtgaggcttgcaactttctcctgtgatgctcatcaacaaaatcggagatgtcggtcctcgacgcctgcggccgatcatttggcttggctgtcgaggtcctcgggtgccgtttgttcggaggggtcttgatgggtcgtcagcgaggaaatcggagttgcctgctcgtggagaggcgatgacgatgacattgcagcctcgacggtgtcctctcgtcagcagtatgtgtgtgatcttgtcagtgccaggtcggctggagtgccctattcgatgggcgtgttttaattaaccgggcaactctcttcttcttaatcagtgaaaatggcaagtcttttacctcgtttcaaaaagagttaaatgcactggaggtcctaaaggtttcgtcggggtgtcactttagtcctatttcttccaaaatgcacctttaggtcctaattctttattaattggttcacccgaggtccttttccacgagcgctcgctgaccagcacacgtgccgcattgacccatgccacatcgatagagggtctaaccgccaggcgagaagcttcgcaaagagacccccccccctcttagtggcaccctctctcctctttcacggtactttggcgacattggaggcgagcgacagaggcaaccggaggtgatctggaggtaatttgtgtgggtgcccgtgaagatgccccttctatgacggccagtgagcaatcctcctccatgttaccgtaagaaccctaatcttgtcgatgatcttctcctgtagctcttctaatatgtcataactttgtcataatcaatagttgtagtccttgatttactttgatttgcataacggtgatacggacacggcaaaaaggacacaccaccagcggcaacatacccgccgaagttggagcttgcttcgccgcgccggcggcggtgctgaggatgttgccatgctcctcatcttagttgtttccttgccgaggagcttgaagttccggccatggataggtttaggggacgcgcgcgccgagagagagagcagatttggggaagaaataaagccagggactggggaatgagaagataatgtttataaggggttttctgtaaaaagaaagagcaacctacgcagcccttctgtcgatttggcatgggtcaacgcaccacacgagcaggtcaacgagcgctcgtgagaaaaaggacctagggtaaaccacttactaaagaattaggacctaaaggtgcattttggacgaaataagactaaagtgacaccctgacgaattttttaggaccttgagtgcatttaactctttcaaaaaataaagatgctaaaaaaactaaatgcttaaaaatacatttttctatgggaatacttaaaaatactagtataatttgatggcttcctagtatatttctagggcttacaactaaatttatattcttggtctaaataaaattataatctgataaattatgtgatatgaatatagccatatgagaccataatttaattttacctgcaaaaagtaagtaatagtagtagtagtactacatactccctccgtccggaaatacttgtcgaagaatttgatgaaaatggatgcatctagaacaagaatacatctagatacatcaatctccctgacaagtatttccgagcggagggagtactagataataagataactaccctaaaaaaaaagataactgaaggttgccacctagcacattcacattggtacaacttggaaaagcacagccccgtcgtcctgctcccagttgagttcgcgacctacacaccggcc

SEQ ID NO: 3163 - DNA, 4660 bp, Triticum aestivum
tttcggcggacgatgctctccgcaggttgcactggactagcttggtgtgaggcttgcaactttctcctgtgatgctcatcaacaaaatcggagatgtcggtcctcgacgcctgcggccgatcatttggcttggctgtcgaggtcctcgggtgccgtttgttcggaggggtcttgatgggtcgtcagcgaggaaatcggagttgcctgctcgtggagaggcgatgacgatgacattgcagcctcgacggtgtcctctcgtcagcagtatgtgtgtgatcttgtcagtgccaggtcggctggagtgccctattcgatgggcgtgttttaattaaccgggcaactctcttcttcttaatcagtgaaaatggcaagtcttttacctcgtttcaaaaagagttaaatgcactggaggtcctaaaggtttcgtcggggtgtcactttagtcctatttcttccaaaatgcacctttaggtcctaattctttattaattggttcacccgaggtccttttccacgagcgctcgctgaccagcacacgtgccgcattgacccatgccacatcgatagagggtctaaccgccaggcgagaagcttcgcaaagagacccccccccctcttagtggcaccctctctcctctttcacggtactttggcgacattggaggcgagcgacagaggcaaccggaggtgatctggaggtaatttgtgtgggtgcccgtgaagatgccccttctatgacggccagtgagcaatcctcctccatgttaccgtaagaaccctaatcttgtcgatgatcttctcctgtagctcttctaatatgtcataactttgtcataatcaatagttgtagtccttgatttactttgatttgcataacggtgatacggacacggcaaaaaggacacaccaccagcggcaacatacccgccgaagttggagcttgcttcgccgcgccggcggcggtgctgaggatgttgccatgctcctcatcttagttgtttccttgccgaggagcttgaagttccggccatggataggtttaggggacgcgcgcgccgagagagagagcagatttggggaagaaataaagccagggactggggaatgagaagataatgtttataaggggttttctgtaaaaagaaagagcaacctacgcagcccttctgtcgatttggcatgggtcaacgcaccacacgagcaggtcaacgagcgctcgtgagaaaaaggacctagggtaaaccacttactaaagaattaggacctaaaggtgcattttggacgaaataagactaaagtgacaccctgacgaattttttaggaccttgagtgcatttaactctttcaaaaaataaagatgctaaaaaaactaaatgcttaaaaatacatttttctatgggaatacttaaaaatactagtataatttgatggcttcctagtatatttctagggcttacaactaaatttatattcttggtctaaataaaattataatctgataaattatgtgatatgaatatagccatatgagaccataatttaattttacctgcaaaaagtaagtaatagtagtagtagtactacatactccctccgtccggaaatacttgtcgaagaatttgatgaaaatggatgcatctagaacaagaatacatctagatacatcaatctccctgacaagtatttccgagcggagggagtactagataataagataactaccctaaaaaaaaagataactgaaggttgccacctagcacattcacattggtacaacttggaaaagcacagccccgtcgtcctgctcccagttgagttcgcgacctacacaccggccatgccccgcttctcctccaccacgccaatgtcgccaccccgcctccgcctccgcctccgactctgcgcccgccactcctcctccacctctcatccctcacgcatctgggatccccacgccgccttcgccgccgcggcacagcgggcgagctctggcacgctcactacggaggacgcacaccacctgtttgacgaattgctgcggcggggcaatcctgtccaggagcgtcccttgaataaatttctggctgccctcgcccgcgcgcccgcgtccgcatcctgctgcgatggccccgccctggcagtcaccctcttcggccgtttgtcccgagacgtcggacgacgggtggcgcagccaaatgtcttcacctatggcgtcctcatggactgctgctgccgcgcttgccgcacagatctggtgctcgccttctttggccgtctcctcaagacgggcctggaggcaaaccaagtcgtcttcaacaccctcctcaagggcctttgccacacaaagcgggcggatgaggctctggacgtgctgcttcacaggatgcctgagctgggctgcactcctaatgtggtggcgtataacaccgttatccatggcttctttaaggaaggccatgtaagcaaggcctgcaatctgttccatgaaatggcgcagcagggcgttaagcctaatgtggtgacatataactcagttattgatgcgctgtgcaaggccagagccatggacaaggcagaggtggtccttcgtcagatgattgatgatggtgttggacctgataatgtgacgtatagtagcctcatccatggatattcctcttcaggccactggaaggaggcagttagggtattcaaagagatgacaagtcggagggttacagcagatgtgcatacttacaacatgtttatgacctttctttgcaaacatggaagaagcaaagaagctgcaggaatttttgataccatggctatcaagggcctgaaacctgacaacgtttcatatgctattcgccttcatgggtatgccaccgaaggatgcctagttgacatgatcaatctcttcaattccatggcaacacactgcattctacctaactgtcatatattcaacatactgattaatgcatatgctaaatctgggaagcttgataaggctatgcttatcttcaatgaaatgcagaaacaaggagtgagtccaaatgcagtcacatattcaaccgtaatacatgcattttgcaagaagggtaggttggatgatgctgtgataaagtttaatcagatgattgatacaggagtacgaccggacgcatctgtttatcgtcccctaatccagggtttttgtacacatggcgatttggtgaaagcaaaggaatatgttactgaaatgatgaagaaaggtatgcctcctcctgatattatgttcttcagttcaatcatgcagaacctatgcacagaaggaagggtaacagaagcacgggatatccttgacttgatagtgcacattggtatgaggcctaatgttatcatatttaatttgctgatcggtggatactgcctagtccgcaagatggcagatgcattgaaagtatttgatgatatggtgtcatatggtttagaaccttgtaactttacgtatggtatacttattaatggctattgcaaaaatagaaggattgatgacgggcttattctgttcaaagagatgctgcacaagggacttaaacctacaacttttaattataacgtcatactggatggattatttctggctggacaaactgttgctgcaaaagagaagtttgatgagatggttgaatctggagtaagtgtgtgcattgatacatactctataattcttggtggactttgtagaaatagctgcagtagcgaagcgatcacccttttccggaaattaagcgcaatgaatgtgaaatttgatattacaattgtcaatatcattattggtgccttatacagggtcgagagaaaccaagaggctaaggatttgtttgctgctatgccagccaatggcttggttcctaatgctgttacctacaccgtaatgatgacaaatcttataaaagaaggttcagtggaagaagctgacaatcttttcttatccatggagaagagcggctgtactgccaactcttgcctgttaaatcatatcatcagaaggttactggaaaaaggagagatagtcaaggctggaaattatatgtctaaagttgatgcaaagagctactcacttgaagctaaaactgtttcgctgctgatctctctgttttcaaggaaagggaaatatagagaacacatcaaattgcttcctacaaagtatcagtttctggaagaagcagccacagttgaataggcatccatggacgtggattgaattgaaggtgtactactgctgtgctggtccgtggatcgtggctgtcatgcatggtttgctgtgtcttctacgatatgtacttccctttgttccgtatatgtacatcttcctcgtttggttcatgtattttcctttgaataataataaataaatcgggctttccatatcggatgcttttatatctgtgtgtatggagattgtggtatatggtttcatctcaagttgtttacgtcaagaactaaagatatttcctcaaaaaaaaagaactaaagatataatcaatgtcattaacataactcatttccatgaggagaggacgaaggacgaagtcataataagtagattggttgatattttataatcattcaaaactgcaggggttataagatcttcattttgtagaagttttagatcttccgaggggttctc

SEQ ID NO: 3164 - DNA, 3822 bp, Triticum aestivum
atgagcaagctggagaagttcaccaactgctactccctgagcaagaccctcaggttcaaggccatcccagtgggcaagacccaagagaacatcgacaacaagaggctgctcgtggaggacgagaagagggccgaggactacaagggcgtgaagaagctcctggaccgctactacctgtccttcatcaacgacgtcctgcactccatcaagctcaagaacctcaacaactacatctccctcttcaggaagaagaccaggaccgagaaggagaacaaggagctggagaacctggagatcaacctccgcaaggagatcgccaaggccttcaagggcaacgagggctacaagtccctcttcaagaaggacatcatcgagaccatcctcccagagttcctcgacgacaaggacgagatcgccctcgtcaactccttcaacggcttcaccaccgccttcaccggcttcttcgacaaccgcgagaatatgttctccgaggaagccaagtccacctccatcgccttcaggtgcatcaacgagaacctcacccgctacatcagcaacatggacatcttcgagaaggtcgacgccatcttcgacaagcacgaggtccaggagatcaaggagaagatcctgaacagcgactacgacgtcgaggacttcttcgagggcgagttcttcaacttcgtgctgacccaagagggcatcgacgtgtacaacgccatcatcggcggcttcgtgaccgagtccggcgagaagatcaagggcctcaacgagtacatcaacctctacaaccagaagaccaagcagaagctcccaaagttcaagccactgtacaagcaagtcctcagcgaccgcgagtccctgagcttctacggcgagggctacacctccgacgaggaagtgctggaggtgttcaggaacaccctcaacaagaactccgagatcttctccagcatcaagaagctggagaaactgttcaagaacttcgacgagtactccagcgccggcatcttcgtgaagaacggcccagccatctccaccatctccaaggacatcttcggcgagtggaacgtcatccgcgacaagtggaacgccgagtacgacgacatccacctgaagaagaaggccgtcgtgaccgagaagtacgaggacgaccgccgcaagagcttcaagaagatcggctccttcagcctggagcaactccaggagtacgccgacgccgacctctccgtcgtggagaagctcaaggagatcatcatccaaaaggtggacgagatctacaaggtgtacggcagctccgagaaactgttcgacgccgacttcgtgctggagaagtccctcaagaagaacgacgccgtggtcgccatcatgaaggacctgctcgactccgtcaagagcttcgagaactacatcaaggccttcttcggcgagggcaaggagaccaacagggacgagtccttctacggcgacttcgtcctcgcctacgacatcctcctgaaggtcgaccacatctacgacgccatcaggaactacgtgacccaaaagccatacagcaaggacaagttcaagctctacttccagaacccacaattcatgggcggctgggacaaggacaaggagaccgactacagggccaccatcctccgctacggcagcaagtactacctggccatcatggacaagaagtacgccaagtgcctccagaagatcgacaaggacgacgtgaacggcaactacgagaagatcaactacaagctgctcccaggcccaaacaagatgctcccaaaggtgttcttctccaagaagtggatggcctactacaacccaagcgaggacatccaaaagatctacaagaacggcaccttcaagaagggcgacatgttcaacctcaacgactgccacaagctcatcgacttcttcaaggactccatcagccgctacccaaagtggagcaacgcctacgacttcaacttctccgagaccgagaagtacaaggacatcgccggcttctacagggaggtcgaggagcaaggctacaaggtgtccttcgagtccgccagcaagaaggaagtggacaagctcgtggaggaaggcaagctgtacatgttccagatctacaacaaggacttctccgacaagagccacggcaccccaaacctccacaccatgtacttcaagctcctgttcgacgagaacaaccacggccaaatcaggctctccggcggcgccgagctgttcatgcgcagggccagcctcaagaaggaggagctcgtcgtgcacccagccaacagcccaatcgccaacaagaacccagacaacccaaagaagaccaccaccctctcctacgacgtgtacaaggacaagaggttcagcgaggaccaatacgagctgcacatcccaatcgccatcaacaagtgcccaaagaatatcttcaagatcaacaccgaggtgcgcgtcctgctcaagcacgacgacaacccatacgtcatcggcatcgacaggggcgagcgcaacctgctctacatcgtggtcgtggacggcaagggcaacatcgtggagcaatacagcctcaacgagatcatcaacaacttcaacggcatcaggatcaagaccgactaccactccctgctcgacaagaaggagaaggagaggttcgaggccaggcaaaactggacctccatcgagaacatcaaggagctgaaggccggctacatctcccaggtggtccacaagatctgcgagctcgtggagaagtacgacgccgtgatcgccctggaggacctcaacagcggcttcaagaacagccgcgtcaaggtggagaagcaagtctaccaaaagttcgagaagatgctgatcgacaagctgaactacatggtggacaagaagtccaacccatgcgccaccggcggcgccctcaagggctaccaaatcaccaacaagttcgagagcttcaagtccatgagcacccaaaacggcttcatcttctacatcccagcctggctcaccagcaagatcgacccatccaccggcttcgtcaacctgctcaagaccaagtacaccagcatcgccgacagcaagaagttcatctccagcttcgaccgcatcatgtatgtgccagaggaagacctcttcgagttcgccctggactacaagaacttctccaggaccgacgccgactacatcaagaagtggaagctctactcctacggcaacaggatccgcatcttcaggaacccaaagaagaacaacgtgttcgactgggaggaagtgtgcctgacctccgcctacaaggagctgttcaacaagtacggcatcaactaccagcaaggcgacatccgcgccctgctctgcgagcagagcgacaaggccttctacagctccttcatggccctgatgagcctcatgctgcaaatgcgcaactccatcaccggccgcaccgacgtggacttcctcatcagcccagtcaagaacagcgacggcatcttctacgactcccgcaactacgaggcccaagagaacgccatcctgccaaagaacgccgacgccaacggcgcctacaacatcgcccgcaaggtgctgtgggccatcggccaattcaagaaggccgaggacgagaagctggacaaggtgaagatcgccatcagcaacaaggagtggctggagtacgcccaaacctccgtgaagcacaagcgcccagccgccaccaagaaggcgggccaagccaagaagaagaagggcagctacccatacgacgtgccagactacgcctacccatacgacgtcccagactacgcctacccatacgacgtgccagactacgcctga

SEQ ID NO: 3165 - DNA, 4104 bp, Triticum aestivum
atggacaagaagtacagcatcgggctcgacatcgggacgaacagcgttgggtgggcggtcatcacggacgagtacaaggttccctccaagaagttcaaggtgctggggaacaccgaccgccactccatcaagaagaacctcatcggggccctcctgttcgacagcggggagaccgctgaggctacgaggctcaagagaaccgcgaggcgcagatacacgagaaggaagaacaggatctgctacctccaagagatcttctccaacgagatggccaaggttgacgattcattcttccaccgcctggaggagtctttcctcgtggaggaggacaagaagcacgagcggcatcccatcttcgggaacatcgtcgacgaggttgcctaccacgagaagtaccctacgatctaccatctgcggaagaagctcgtggacagcaccgataaggcggacctcagactgatctacctcgccctggcgcacatgatcaagttccgcgggcatttcctgatcgagggggatctcaacccagacaactccgatgttgacaagctgttcatccaactcgtgcagacctacaaccaactcttcgaggagaacccgatcaacgcttcgggggtcgacgctaaggccatcctgtcagcccgcctctcgaagtcacgcaggctggagaacctgatcgcgcagctcccaggggagaagaagaacgggctgttcgggaacctcatcgctctctctctggggctcacgccgaacttcaagtccaacttcgatctcgccgaggacgcgaagctgcaactcagcaaggacacctacgacgatgacctcgataacctcctggcgcagatcggggatcaatacgctgacctgttcctcgccgcgaagaacctgtcggacgccatcctcctgtcagatatcctccgcgtgaacaccgagatcacgaaggccccactctctgcgtccatgatcaagcgctacgacgagcaccatcaggatctgaccctcctgaaggcgctggtccgccaacagctcccggagaagtacaaggagatcttcttcgatcagtcgaagaacgggtacgctgggtacatcgacgggggggcgtcacaagaggagttctacaagttcatcaagccaatcctggagaagatggacgggacggaggagctcctggtgaagctcaacagggaggacctcctgcggaagcagagaaccttcgataacgggtccatcccccaccaaatccatctcggggagctgcacgccatcctgagaaggcaagaggacttctaccctttcctcaaggataaccgggagaagatcgagaagatcctgaccttcagaatcccatactacgtcgggccgctcgctcgggggaacagcagattcgcctggatgacccgcaagtcggaggagaccatcacgccgtggaacttcgaggaggtggtcgacaagggggcgagcgctcagtcgttcatcgagaggatgaccaacttcgacaagaacctgcccaacgagaaggtgctccctaagcactcgctcctgtacgagtacttcaccgtctacaacgagctcacgaaggtgaagtatgtgaccgaggggatgagaaagcctgccttcctgtccggggagcagaagaaggcgatcgtggacctcctgttcaagaccaaccggaaggtcacggttaagcaactcaaggaggactacttcaagaagatcgagtgcttcgattcggtggagatctcaggggtcgaggacaggttcaacgcctccctcgggacctaccacgatctcctgaagatcatcaaggataaggacttcctggacaacgaggagaacgaggacatcctggaggacatcgtgctgaccctcacgctgttcgaggacagggagatgatcgaggagcgcctgaagacgtacgcccatctcttcgatgacaaggtcatgaagcaactcaagagaagaagatacaccgggtgggggaggctgtcccgcaagctcatcaacgggatccgggacaagcagtcagggaagaccatcctcgacttcctgaagtctgatgggttcgccaacaggaacttcatgcaactgatccacgatgactcactcaccttcaaggaggatatccaaaaggctcaggtgagcgggcagggggactcgctgcacgagcatatcgctaacctcgctgggtcccctgcgatcaagaaggggatcctgcagaccgtgaaggttgtggacgagctcgtgaaggtcatggggcggcataagcctgagaacatcgtcatcgagatggccagagagaaccaaaccacgcagaaggggcaaaagaactctagggagcgcatgaagcgcatcgaggaggggatcaaggagctggggtcccaaatcctcaaggagcacccagttgagaacacccaactgcagaacgagaagctctacctgtactacctccagaacgggagggatatgtatgtggaccaagagctggatatcaaccgcctcagcgattacgacgttgatcatatcgtgccccagtctttcctgaaggatgactccatcgacaacaaggtcctcaccaggtcggacaagaaccgcgggaagtcagataacgttccatctgaggaggtcgttaagaagatgaagaactactggaggcagctcctgaacgccaagctgatcacgcaaaggaagttcgacaacctcaccaaggctgagagaggggggctctcagagctggacaaggctgggttcatcaagcggcagctggtcgagaccagacaaatcacgaagcacgttgcgcaaatcctcgactctcggatgaacacgaagtacgatgagaacgacaagctgatcagggaggtgaaggtcatcaccctgaagtctaagctcgtctccgacttccgcaaggacttccagttctacaaggttcgcgagatcaacaactaccaccatgcgcatgacgcttacctcaacgctgtggtcgggaccgccctgatcaagaagtacccgaagctggagagcgagttcgtgtacggggactacaaggtttacgatgtgcgcaagatgatcgccaagtcggagcaagagatcgggaaggccaccgccaagtacttcttctactcaaacatcatgaacttctttaagaccgagatcacgctggccaacggggagatccggaagagacccctcatcgagaccaacggggagacgggggagatcgtgtgggacaaggggagggatttcgcgaccgtccgcaaggttctctccatgccccaggtgaacatcgtcaagaagaccgaggtccaaacgggggggttctcaaaggagtctatcctgcctaagcggaacagcgacaagctcatcgccagaaagaaggactgggatccaaagaagtacggggggttcgacagccctaccgtcgcgtactcggttctggttgtggctaaggttgagaaggggaagtccaagaagctcaagagcgtgaaggagctcctggggatcaccatcatggagcgctccagcttcgagaagaacccaatcgacttcctggaggccaaggggtacaaggaggtgaagaaggacctgatcatcaagctcccgaagtactctctcttcgagctggagaacgggaggaagcgcatgctggcttccgctggggagctccaaaaggggaacgagctcgccctgccatccaagtatgtgaacttcctctacctggcgtcccactacgagaagctcaaggggagcccggaggacaacgagcaaaagcagctgttcgtcgagcagcacaagcattacctcgacgagatcatcgagcaaatctccgagttctccaagcgcgtgatcctcgcggacgctaacctggataaggtcctctccgcttacaacaagcaccgggacaagcccatcagagagcaggccgagaacatcatccatctcttcaccctgacgaacctcggggcccctgctgccttcaagtacttcgacaccacgatcgatcggaagagatacaccagcacgaaggaggtcctggacgcgaccctcatccaccaatctatcacggggctgtacgagacgagaatcgacctgtcacaactggggggggac

SEQ ID NO: 3166 - DNA, 7428 bp, Triticum aestivum
gaccaagcccgttattctgacagttctggtgctcaacacatttatatttatcaaggagcacattgttactcactgctaggagggaatcgaactaggaatattgatcagaggaactacgagagagctgaagataactgccctctagctctcactgatctgggtcgcatagtgagatgcagcccacgtgagttcagcaacggtctagcgctgggcttttaggcccgcatgatcgggcttttgtcgggtggtcgacgtgttcacgattggggagagcaacgcagcagttcctcttagtttagtcccacctcgcctgtccagcagagttctgaccggtttataaactcgcttgctgcatcagacttggaaagacaattatttaggaagttttagagctagaaatagcaagttaaaataaggctagtccgttatcaacttgaaaaagtggcaccgagtcggtgctttttttgaccaagcccgttattctgacagttctggtgctcaacacatttatatttatcaaggagcacattgttactcactgctaggagggaatcgaactaggaatattgatcagaggaactacgagagagctgaagataactgccctctagctctcactgatctgggtcgcatagtgagatgcagcccacgtgagttcagcaacggtctagcgctgggcttttaggcccgcatgatcgggcttttgtcgggtggtcgacgtgttcacgattggggagagcaacgcagcagttcctcttagtttagtcccacctcgcctgtccagcagagttctgaccggtttataaactcgcttgctgcatcagacttggacaattatttaggaacggagttttagagctagaaatagcaagttaaaataaggctagtccgttatcaacttgaaaaagtggcaccgagtcggtgctttttttgtgtggcaaacagctattatgggtattatgggtggagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtctccaccatggctcctaagaagaagcgcaaggttgggatccacggggttccggcggctatggacaagaagtacagcatcgggctcgacatcgggacgaacagcgttgggtgggcggtcatcacggacgagtacaaggttccctccaagaagttcaaggtgctggggaacaccgaccgccactccatcaagaagaacctcatcggggccctcctgttcgacagcggggagaccgctgaggctacgaggctcaagagaaccgcgaggcgcagatacacgagaaggaagaacaggatctgctacctccaagagatcttctccaacgagatggccaaggttgacgattcattcttccaccgcctggaggagtctttcctcgtggaggaggacaagaagcacgagcggcatcccatcttcgggaacatcgtcgacgaggttgcctaccacgagaagtaccctacgatctaccatctgcggaagaagctcgtggacagcaccgataaggcggacctcagactgatctacctcgccctggcgcacatgatcaagttccgcgggcatttcctgatcgagggggatctcaacccagacaactccgatgttgacaagctgttcatccaactcgtgcagacctacaaccaactcttcgaggagaacccgatcaacgcttcgggggtcgacgctaaggccatcctgtcagcccgcctctcgaagtcacgcaggctggagaacctgatcgcgcagctcccaggggagaagaagaacgggctgttcgggaacctcatcgctctctctctggggctcacgccgaacttcaagtccaacttcgatctcgccgaggacgcgaagctgcaactcagcaaggacacctacgacgatgacctcgataacctcctggcgcagatcggggatcaatacgctgacctgttcctcgccgcgaagaacctgtcggacgccatcctcctgtcagatatcctccgcgtgaacaccgagatcacgaaggccccactctctgcgtccatgatcaagcgctacgacgagcaccatcaggatctgaccctcctgaaggcgctggtccgccaacagctcccggagaagtacaaggagatcttcttcgatcagtcgaagaacgggtacgctgggtacatcgacgggggggcgtcacaagaggagttctacaagttcatcaagccaatcctggagaagatggacgggacggaggagctcctggtgaagctcaacagggaggacctcctgcggaagcagagaaccttcgataacgggtccatcccccaccaaatccatctcggggagctgcacgccatcctgagaaggcaagaggacttctaccctttcctcaaggataaccgggagaagatcgagaagatcctgaccttcagaatcccatactacgtcgggccgctcgctcgggggaacagcagattcgcctggatgacccgcaagtcggaggagaccatcacgccgtggaacttcgaggaggtggtcgacaagggggcgagcgctcagtcgttcatcgagaggatgaccaacttcgacaagaacctgcccaacgagaaggtgctccctaagcactcgctcctgtacgagtacttcaccgtctacaacgagctcacgaaggtgaagtatgtgaccgaggggatgagaaagcctgccttcctgtccggggagcagaagaaggcgatcgtggacctcctgttcaagaccaaccggaaggtcacggttaagcaactcaaggaggactacttcaagaagatcgagtgcttcgattcggtggagatctcaggggtcgaggacaggttcaacgcctccctcgggacctaccacgatctcctgaagatcatcaaggataaggacttcctggacaacgaggagaacgaggacatcctggaggacatcgtgctgaccctcacgctgttcgaggacagggagatgatcgaggagcgcctgaagacgtacgcccatctcttcgatgacaaggtcatgaagcaactcaagagaagaagatacaccgggtgggggaggctgtcccgcaagctcatcaacgggatccgggacaagcagtcagggaagaccatcctcgacttcctgaagtctgatgggttcgccaacaggaacttcatgcaactgatccacgatgactcactcaccttcaaggaggatatccaaaaggctcaggtgagcgggcagggggactcgctgcacgagcatatcgctaacctcgctgggtcccctgcgatcaagaaggggatcctgcagaccgtgaaggttgtggacgagctcgtgaaggtcatggggcggcataagcctgagaacatcgtcatcgagatggccagagagaaccaaaccacgcagaaggggcaaaagaactctagggagcgcatgaagcgcatcgaggaggggatcaaggagctggggtcccaaatcctcaaggagcacccagttgagaacacccaactgcagaacgagaagctctacctgtactacctccagaacgggagggatatgtatgtggaccaagagctggatatcaaccgcctcagcgattacgacgttgatcatatcgtgccccagtctttcctgaaggatgactccatcgacaacaaggtcctcaccaggtcggacaagaaccgcgggaagtcagataacgttccatctgaggaggtcgttaagaagatgaagaactactggaggcagctcctgaacgccaagctgatcacgcaaaggaagttcgacaacctcaccaaggctgagagaggggggctctcagagctggacaaggctgggttcatcaagcggcagctggtcgagaccagacaaatcacgaagcacgttgcgcaaatcctcgactctcggatgaacacgaagtacgatgagaacgacaagctgatcagggaggtgaaggtcatcaccctgaagtctaagctcgtctccgacttccgcaaggacttccagttctacaaggttcgcgagatcaacaactaccaccatgcgcatgacgcttacctcaacgctgtggtcgggaccgccctgatcaagaagtacccgaagctggagagcgagttcgtgtacggggactacaaggtttacgatgtgcgcaagatgatcgccaagtcggagcaagagatcgggaaggccaccgccaagtacttcttctactcaaacatcatgaacttctttaagaccgagatcacgctggccaacggggagatccggaagagacccctcatcgagaccaacggggagacgggggagatcgtgtgggacaaggggagggatttcgcgaccgtccgcaaggttctctccatgccccaggtgaacatcgtcaagaagaccgaggtccaaacgggggggttctcaaaggagtctatcctgcctaagcggaacagcgacaagctcatcgccagaaagaaggactgggatccaaagaagtacggggggttcgacagccctaccgtcgcgtactcggttctggttgtggctaaggttgagaaggggaagtccaagaagctcaagagcgtgaaggagctcctggggatcaccatcatggagcgctccagcttcgagaagaacccaatcgacttcctggaggccaaggggtacaaggaggtgaagaaggacctgatcatcaagctcccgaagtactctctcttcgagctggagaacgggaggaagcgcatgctggcttccgctggggagctccaaaaggggaacgagctcgccctgccatccaagtatgtgaacttcctctacctggcgtcccactacgagaagctcaaggggagcccggaggacaacgagcaaaagcagctgttcgtcgagcagcacaagcattacctcgacgagatcatcgagcaaatctccgagttctccaagcgcgtgatcctcgcggacgctaacctggataaggtcctctccgcttacaacaagcaccgggacaagcccatcagagagcaggccgagaacatcatccatctcttcaccctgacgaacctcggggcccctgctgccttcaagtacttcgacaccacgatcgatcggaagagatacaccagcacgaaggaggtcctggacgcgaccctcatccaccaatctatcacggggctgtacgagacgagaatcgacctgtcacaactggggggggacaagaggccggcggcaaccaagaaggcgggccaggccaagaagaagaagtgaaacgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactag

SEQ ID NO: 3167 - DNA, 7011 bp, Triticum aestivum
gaccaagcccgttattctgacagttctggtgctcaacacatttatatttatcaaggagcacattgttactcactgctaggagggaatcgaactaggaatattgatcagaggaactacgagagagctgaagataactgccctctagctctcactgatctgggtcgcatagtgagatgcagcccacgtgagttcagcaacggtctagcgctgggcttttaggcccgcatgatcgggcttttgtcgggtggtcgacgtgttcacgattggggagagcaacgcagcagttcctcttagtttagtcccacctcgcctgtccagcagagttctgaccggtttataaactcgcttgctgcatcagacttgtaatttctactaagtgtagatcgagcggagggagtactagataatttttttgtgctctcttaaggtagcggagaccaagcccgttattctgacagttctggtgctcaacacatttatatttatcaaggagcacattgttactcactgctaggagggaatcgaactaggaatattgatcagaggaactacgagagagctgaagataactgccctctagctctcactgatctgggtcgcatagtgagatgcagcccacgtgagttcagcaacggtctagcgctgggcttttaggcccgcatgatcgggcttttgtcgggtggtcgacgtgttcacgattggggagagcaacgcagcagttcctcttagtttagtcccacctcgcctgtccagcagagttctgaccggtttataaactcgcttgctgcatcagacttgtaatttctactaagtgtagattttgagatagctagaaagacaattttttttgtgtggcaaacagctattatgggtattatgggtggagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtctccaccatgagcaagctggagaagttcaccaactgctactccctgagcaagaccctcaggttcaaggccatcccagtgggcaagacccaagagaacatcgacaacaagaggctgctcgtggaggacgagaagagggccgaggactacaagggcgtgaagaagctcctggaccgctactacctgtccttcatcaacgacgtcctgcactccatcaagctcaagaacctcaacaactacatctccctcttcaggaagaagaccaggaccgagaaggagaacaaggagctggagaacctggagatcaacctccgcaaggagatcgccaaggccttcaagggcaacgagggctacaagtccctcttcaagaaggacatcatcgagaccatcctcccagagttcctcgacgacaaggacgagatcgccctcgtcaactccttcaacggcttcaccaccgccttcaccggcttcttcgacaaccgcgagaatatgttctccgaggaagccaagtccacctccatcgccttcaggtgcatcaacgagaacctcacccgctacatcagcaacatggacatcttcgagaaggtcgacgccatcttcgacaagcacgaggtccaggagatcaaggagaagatcctgaacagcgactacgacgtcgaggacttcttcgagggcgagttcttcaacttcgtgctgacccaagagggcatcgacgtgtacaacgccatcatcggcggcttcgtgaccgagtccggcgagaagatcaagggcctcaacgagtacatcaacctctacaaccagaagaccaagcagaagctcccaaagttcaagccactgtacaagcaagtcctcagcgaccgcgagtccctgagcttctacggcgagggctacacctccgacgaggaagtgctggaggtgttcaggaacaccctcaacaagaactccgagatcttctccagcatcaagaagctggagaaactgttcaagaacttcgacgagtactccagcgccggcatcttcgtgaagaacggcccagccatctccaccatctccaaggacatcttcggcgagtggaacgtcatccgcgacaagtggaacgccgagtacgacgacatccacctgaagaagaaggccgtcgtgaccgagaagtacgaggacgaccgccgcaagagcttcaagaagatcggctccttcagcctggagcaactccaggagtacgccgacgccgacctctccgtcgtggagaagctcaaggagatcatcatccaaaaggtggacgagatctacaaggtgtacggcagctccgagaaactgttcgacgccgacttcgtgctggagaagtccctcaagaagaacgacgccgtggtcgccatcatgaaggacctgctcgactccgtcaagagcttcgagaactacatcaaggccttcttcggcgagggcaaggagaccaacagggacgagtccttctacggcgacttcgtcctcgcctacgacatcctcctgaaggtcgaccacatctacgacgccatcaggaactacgtgacccaaaagccatacagcaaggacaagttcaagctctacttccagaacccacaattcatgggcggctgggacaaggacaaggagaccgactacagggccaccatcctccgctacggcagcaagtactacctggccatcatggacaagaagtacgccaagtgcctccagaagatcgacaaggacgacgtgaacggcaactacgagaagatcaactacaagctgctcccaggcccaaacaagatgctcccaaaggtgttcttctccaagaagtggatggcctactacaacccaagcgaggacatccaaaagatctacaagaacggcaccttcaagaagggcgacatgttcaacctcaacgactgccacaagctcatcgacttcttcaaggactccatcagccgctacccaaagtggagcaacgcctacgacttcaacttctccgagaccgagaagtacaaggacatcgccggcttctacagggaggtcgaggagcaaggctacaaggtgtccttcgagtccgccagcaagaaggaagtggacaagctcgtggaggaaggcaagctgtacatgttccagatctacaacaaggacttctccgacaagagccacggcaccccaaacctccacaccatgtacttcaagctcctgttcgacgagaacaaccacggccaaatcaggctctccggcggcgccgagctgttcatgcgcagggccagcctcaagaaggaggagctcgtcgtgcacccagccaacagcccaatcgccaacaagaacccagacaacccaaagaagaccaccaccctctcctacgacgtgtacaaggacaagaggttcagcgaggaccaatacgagctgcacatcccaatcgccatcaacaagtgcccaaagaatatcttcaagatcaacaccgaggtgcgcgtcctgctcaagcacgacgacaacccatacgtcatcggcatcgacaggggcgagcgcaacctgctctacatcgtggtcgtggacggcaagggcaacatcgtggagcaatacagcctcaacgagatcatcaacaacttcaacggcatcaggatcaagaccgactaccactccctgctcgacaagaaggagaaggagaggttcgaggccaggcaaaactggacctccatcgagaacatcaaggagctgaaggccggctacatctcccaggtggtccacaagatctgcgagctcgtggagaagtacgacgccgtgatcgccctggaggacctcaacagcggcttcaagaacagccgcgtcaaggtggagaagcaagtctaccaaaagttcgagaagatgctgatcgacaagctgaactacatggtggacaagaagtccaacccatgcgccaccggcggcgccctcaagggctaccaaatcaccaacaagttcgagagcttcaagtccatgagcacccaaaacggcttcatcttctacatcccagcctggctcaccagcaagatcgacccatccaccggcttcgtcaacctgctcaagaccaagtacaccagcatcgccgacagcaagaagttcatctccagcttcgaccgcatcatgtatgtgccagaggaagacctcttcgagttcgccctggactacaagaacttctccaggaccgacgccgactacatcaagaagtggaagctctactcctacggcaacaggatccgcatcttcaggaacccaaagaagaacaacgtgttcgactgggaggaagtgtgcctgacctccgcctacaaggagctgttcaacaagtacggcatcaactaccagcaaggcgacatccgcgccctgctctgcgagcagagcgacaaggccttctacagctccttcatggccctgatgagcctcatgctgcaaatgcgcaactccatcaccggccgcaccgacgtggacttcctcatcagcccagtcaagaacagcgacggcatcttctacgactcccgcaactacgaggcccaagagaacgccatcctgccaaagaacgccgacgccaacggcgcctacaacatcgcccgcaaggtgctgtgggccatcggccaattcaagaaggccgaggacgagaagctggacaaggtgaagatcgccatcagcaacaaggagtggctggagtacgcccaaacctccgtgaagcacaagcgcccagccgccaccaagaaggcgggccaagccaagaagaagaagggcagctacccatacgacgtgccagactacgcctacccatacgacgtcccagactacgcctacccatacgacgtgccagactacgcctgaaacgcatccaatccaatatggacgattggacgtggaaggtttcctgtgtcttctacgatataataattggtcgctgtcctgtgtggatgtttcctgtgtcttctacgatatattaatgtacttctgtctgtttcgtttcgtatgtacaatcttccgggtatcgttcatgtatccctttgaataataacaaataaaatcgggtttgtcacggtaatctgaataaccttttattagccaaagtttaaccaaaattacgtattgcacgtaaaaattaagctagtttttggagagccggagacagac

SEQ ID NO: 3168 - DNA, 362 bp, Triticum aestivum
gaccaagcccgttattctgacagttctggtgctcaacacatttatatttatcaaggagcacattgttactcactgctaggagggaatcgaactaggaatattgatcagaggaactacgagagagctgaagataactgccctctagctctcactgatctgggtcgcatagtgagatgcagcccacgtgagttcagcaacggtctagcgctgggcttttaggcccgcatgatcgggcttttgtcgggtggtcgacgtgttcacgattggggagagcaacgcagcagttcctcttagtttagtcccacctcgcctgtccagcagagttctgaccggtttataaactcgcttgctgcatcagactt

SEQ ID NO: 3169 - DNA, 7 bp, Triticum aestivum
ttttttt

SEQ ID NO: 3170 - DNA, 300 bp, Triticum aestivum
gcatccaatccaatatggacgattggacgtggaaggtttcctgtgtcttctacgatataataattggtcgctgtcctgtgtggatgtttcctgtgtcttctacgatatattaatgtacttctgtctgtttcgtttcgtatgtacaatcttccgggtatcgttcatgtatccctttgaataataacaaataaaatcgggtttgtcacggtaatctgaataaccttttattagccaaagtttaaccaaaattacgtattgcacgtaaaaattaagctagtttttggagagccggagacagac

SEQ ID NO: 3171 - DNA, 250 bp, Triticum aestivum
gatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactag

SEQ ID NO: 3172 - DNA, 48 bp, Triticum aestivum
aagaggccggcggcaaccaagaaggcgggccaggccaagaagaagaag

SEQ ID NO: 3173 - DNA, 51 bp, Triticum aestivum
atggctcctaagaagaagcgcaaggttgggatccacggggttccggcggct

SEQ ID NO: 3174 - DNA, 163 bp, Triticum aestivum
ctccctccgttcctaaataattgtctttctagctatctcaaataaactacaacatacggatgtatgtagacatgttttagagtgtagattcactcattttgttccgtatgtagtcatttgttgaaatctctagagagacaattatttaggaacggagggagta

SEQ ID NO: 3175 - DNA, 44 bp, Triticum aestivum
taatttctactaagtgtagatcgagcggagggagtactagataa

SEQ ID NO: 3176 - DNA, 44 bp, Triticum aestivum
taatttctactaagtgtagatggaacggagggagtattatctag

SEQ ID NO: 3177 - DNA, 44 bp, Triticum aestivum
taatttctactaagtgtagatagatagctagaaagacaattatt

SEQ ID NO: 3178 - DNA, 44 bp, Triticum aestivum
taatttctactaagtgtagattttgagatagctagaaagacaat

SEQ ID NO: 3179 - DNA, 100 bp, Triticum aestivum
tgacaagtatttccgagcgggttttagagctagaaatagcaagttaaaataaggctagtccgttatcaacttgaaaaagtggcaccgagtcggtgctttt

SEQ ID NO: 3180 - DNA, 100 bp, Triticum aestivum
gacaattatttaggaacggagttttagagctagaaatagcaagttaaaataaggctagtccgttatcaacttgaaaaagtggcaccgagtcggtgctttt

SEQ ID NO: 3181 - DNA, 100 bp, Triticum aestivum
agacaattatttaggaacgggttttagagctagaaatagcaagttaaaataaggctagtccgttatcaacttgaaaaagtggcaccgagtcggtgctttt

SEQ ID NO: 3182 - DNA, 100 bp, Triticum aestivum
gaaagacaattatttaggaagttttagagctagaaatagcaagttaaaataaggctagtccgttatcaacttgaaaaagtggcaccgagtcggtgctttt

SEQ ID NO: 3183 - DNA, 100 bp, Triticum aestivum
agctagaaagacaattatttgttttagagctagaaatagcaagttaaaataaggctagtccgttatcaacttgaaaaagtggcaccgagtcggtgctttt

SEQ ID NO: 3184 - DNA, 100 bp, Triticum aestivum
tttcaacaaatgactacatagttttagagctagaaatagcaagttaaaataaggctagtccgttatcaacttgaaaaagtggcaccgagtcggtgctttt

SEQ ID NO: 3185 - DNA, 100 bp, Triticum aestivum
ctctagagagacaattatttgttttagagctagaaatagcaagttaaaataaggctagtccgttatcaacttgaaaaagtggcaccgagtcggtgctttt

SEQ ID NO: 3186 - DNA, 100 bp, Triticum aestivum
gagagacaattatttaggaagttttagagctagaaatagcaagttaaaataaggctagtccgttatcaacttgaaaaagtggcaccgagtcggtgctttt

SEQ ID NO: 3187 - DNA, 71 bp, Triticum aestivum
caaaggcttgacaatgataatgcccccgaatcttgygatagacctcatgcgctagagttgttttcctcaat

SEQ ID NO: 3188 - DNA, 71 bp, Triticum aestivum
gacaaagttgaggtgaacaaaacaggcctacaatcmgctaacttacgtatatccacattagcacacaccac

SEQ ID NO: 3189 - DNA, 71 bp, Triticum aestivum
aaattcgacaagtactatggctatgtctctgaatgyttgtttggttttatttgtctatattgtcgttgtat

SEQ ID NO: 3190 - DNA, 71 bp, Triticum aestivum
atgcaaagtagtactcgtagagagttaacacagacsagtgatttattgggtggtattctacttgatatttg

SEQ ID NO: 3191 - DNA, 201 bp, Triticum aestivum
ataaagaaaagtagaggaagcttatgaataaaatggaaaaggaattcaaaattgccgataaatataaaactcataacaaatctagccacgcaaatgcccgygccgctctgctcgtttgtacatgtctcggtggacaaggaagaacccaacaattgcacaggtcaatcttatccagcaaaacaaggaagcaaaccaaacagg

SEQ ID NO: 3192 - DNA, 80 bp, Triticum aestivum
atgttgcctctcgctagccgctgtcgmacccaatgaataatgttkmtgggttctggctccgagaggatggccggctyccc

SEQ ID NO: 3193 - DNA, 53 bp, Triticum aestivum
gttccttgtgacatgtactcatamacaagagccatatactccccatccttgca

SEQ ID NO: 3194 - DNA, 201 bp, Triticum aestivum
gacataatgtgtaataacagcccataatgcaataaatatcaatataaaagcatgatgcaaaatggacgtatcattgccacgraaaaaatctcacaagatgwgaccatttgatcctcrtaattgttgttctagacccactcctaagtmtaacattctttatgtctatycttcaaatcccgaagagtaatgaaaactatcgaa

SEQ ID NO: 3195 - DNA, 201 bp, Triticum aestivum
ccatgagtacccgctactatcgatctccctcctccctgtaggaggcctacgaacgatgccctcaggtcctgcttcctctcggtagcgatggatccacctgyggttgctctctcaggaaccagtgttggcggcggctcatccggggcgctggatcttggtgatgtgctggaacaactcaacttggaagacgaagaatttgat

SEQ ID NO: 3196 - DNA, 71 bp, Triticum aestivum
gacaatatgattcaccctagatccttcaccttacarttcgaaaaaaataaaagaacaaaagtaatttgaca

SEQ ID NO: 3197 - DNA, 71 bp, Triticum aestivum
acgaagatgaggaaggtcttcatgttgggtttatgrttactaatacttgcttggaatagatgtttttgatc

SEQ ID NO: 3198 - DNA, 121 bp, Triticum aestivum
gttaccccaatatgctccctccttgcacattttcttcagctgcataaaaamcagaataccrcatcagttgcctgaaccttaacgcaggtgcagaaataaggcgacataatttycactaatc

SEQ ID NO: 3199 - DNA, 71 bp, Triticum aestivum
aggaaaataaattgttcacaacatggacatgagaayggggcaaccaaaaagggaagaacattggaggaaac

SEQ ID NO: 3200 - DNA, 71 bp, Triticum aestivum
tttgtactgcacgtagtaagtattgatttttctgtktgctctctgtggacttagatttgaaaattggcctt

SEQ ID NO: 3201 - DNA, 71 bp, Triticum aestivum
atgcacattgtttccatgttaagcttatattgtgcrtaactcaaaagattgaaatggaattaccaaagggc

SEQ ID NO: 3202 - DNA, 71 bp, Triticum aestivum
actgactgttggaatctgattaagacgctggagaayccgagccaagatatgtcacgactaggccatctgga

SEQ ID NO: 3203 - DNA, 71 bp, Triticum aestivum
aatcagatcctgttaatgctgtagccattcttgcargcgacaccttgtcccagtcgtcttatgggcactta

SEQ ID NO: 3204 - DNA, 101 bp, Triticum aestivum
ggcagagccggtcgacggagaggagcgccattcgacgcgtcttccgcaatrtgtttgcctgcttcggccgcggccattcggcgagctcccacgcttcgtcc

SEQ ID NO: 3205 - DNA, 71 bp, Triticum aestivum
cgtttaaaagaacacaaatgtggccctagtgatcargtacacatatttgtcacctctttgaatcttactta

SEQ ID NO: 3206 - DNA, 108 bp, Triticum aestivum
cgggctgatgaggctctcgacgtgctgcttcacaggatgcctgagctgggctgcacycccaacgtggtggcatataccacggtcatccacggcttctttaaggaaggc

SEQ ID NO: 3207 - DNA, 106 bp, Triticum aestivum
gcgctatccggcgtcgtgttccctcttgggggaatcgtcctggagatggatccggtcaraggggcccgtgatttgtgaggatgtgtgtgttgtttcccgaaaggcg

SEQ ID NO: 3208 - DNA, 110 bp, Triticum aestivum
ctttgaccttaaattcttgtactaatttagcagaatcgttcttcgagaagcactcmaaaaatggtttgtcttgggtctgtatcatattttctctgaacaaacaggcgtga

SEQ ID NO: 3209 - DNA, 106 bp, Triticum aestivum
gacttagcctcacacggaatcgagtcaaccaattccygtcggttttgagtggctcccttgaagatgcaatcgttttcagcatggtcagattaatcagcgagcgtgc

SEQ ID NO: 3210 - DNA, 113 bp, Triticum aestivum
catgtagtggctggcgtctaagcgccttttcttcttccagcatctaygacttagcctcacacggaatcgagtcaaccaattcctgtcggttttgagtggctcccttgaagatg

SEQ ID NO: 3211 - DNA, 88 bp, Triticum aestivum
gtcgtatatattgtttgtattaaaaagttgtgtgttttgmgtcataatttttaaaatattattatgtcattttcaaattcgcatcaac

SEQ ID NO: 3212 - DNA, 97 bp, Triticum aestivum
aatcttcttgacttcatccatccgccttgttgccctgcgcaaaatcaaactyccccgtccttatcatcaagtcaggtcccgccctgggcagagagag

SEQ ID NO: 3213 - DNA, 73 bp, Triticum aestivum
cggcagatatcacaaagggctatcctggtgaacaayaagatgggtcagaatttgataatgaagcctcaagccc

SEQ ID NO: 3214 - DNA, 201 bp, Triticum aestivum
aatagatgcacgcatcggcgaccattttttagtactttttgccttttttgaaaattttgtcattaaaagacaaatgcctagtctatacctgataaactaawatcatacatagagaaaatggtcatttggttgagtttcggtacatgctgagatggttgcacttcggtgcatctgctttgcttccatcacatcataatgtct

SEQ ID NO: 3215 - DNA, 65 bp, Triticum aestivum
gctgcttgtagcgtcccccatggcacctgygaagaggttttcggccacagagaaggggaaggctc

SEQ ID NO: 3216 - DNA, 201 bp, Triticum aestivum
aaaattacttttcacgcgcttcgttggtctgacagtgcgagcataattttactttttctcagttttacttaatttggttaaccaaatcctttttgattttkaactagaaaaccgaatgtcaaacattgtgcaaatttggaaactgaaactgaaaccaaaaacctaaaaaaatgattagtttgtttttttgttcttgtttcg

SEQ ID NO: 3217 - DNA, 66 bp, Triticum aestivum
gtatttcttaggattttctcaccggcatctccrttttttgagcaagagtatttaaggatggtaggc

SEQ ID NO: 3218 - DNA, 201 bp, Triticum aestivum
aacaaagatgctagtaagaacatgaacctagttgctcatttttaacaacaattgcccaccaacctgacatgctcttcccatgttctttttttgctcaaaayagagatgctagtccaaatatttttctagttgcttacattttaaacaacaattgcctaccatccttaaatactcttgctcaaaaaacggagatgccggtga

SEQ ID NO: 3219 - DNA, 60 bp, Triticum aestivum
aatacagactgggtgcaaagccaagatgatwgtaaaattgattgatggccgttgggaggt

SEQ ID NO: 3220 - DNA, 201 bp, Triticum aestivum
tgtaaagaagcttaaccaggaaagctatcagggccatagggaatggctggttagtgacaattttgcctgctggaaatgggatttcttgtttatttcagttytgcattgtgtctgacatgctctttcttttgggcgcaggctgaagtgaattaccttggacaactatcgcacccgaatcttgtaaagctcgttgggtactgt

SEQ ID NO: 3221 - DNA, 87 bp, Triticum aestivum
tggcggagctggggctgttcctcctacgcaggcgaaacttcgccgcgataaayggaactatcatcaggttccccgatgatccatacg

SEQ ID NO: 3222 - DNA, 81 bp, Triticum aestivum
acaagcaaccgagacaagttgctcttaattatctgtgcgtrcacctctaagtcttaacctgacgtaaccaaccaaccgtgt

SEQ ID NO: 3223 - DNA, 90 bp, Triticum aestivum
gatggttacaaggcatgcatagcaagtagagttaacttatcaagttattrgtatttttcttctgtggtacttagagtctamagcttgagc

SEQ ID NO: 3224 - DNA, 201 bp, Triticum aestivum
aatggaagctgatgtgcgttagcgataaagcaacagcgataacgacgcatggatcaccatgctacttggggaagcagggacatctgatgagccagcatacmcccagatatgtgtctttccaaattccacgtcccaacagatgagctataaattaatgccaccttcctcctacagctaaatactccatccgtttcataatgt

SEQ ID NO: 3225 - DNA, 201 bp, Triticum aestivum
cagaggcattcgtgaattgggcgaaatcagaagcaaggagcagcgatgttcagcgcagaaggcactgggaggggattccagggaggctgcccaccagcccrccatcagatacggaggaggtggatccatggccctacctgtgtcctgcgccgaatctggactgtggtaactacagcgcctgaatctagaggttcagcctgg

SEQ ID NO: 3226 - DNA, 201 bp, Triticum aestivum
gatccatctcccttaataattttgctattggtattgggtatggacatctgaagtgaaggttacggccgatttataggagtgatagcaccacacaattcatmagagcatctgcaatagatgagtagatgtaaaactacttaacttttacatctccgggcctaaaaacgcatctgtaataagataatgtagatgtaaagaaaa

SEQ ID NO: 3227 - DNA, 101 bp, Triticum aestivum
cgacgacgacgaggatgccgagtttgatgacatggaggattatatcgacgrcgcggactgggacgccgacatgtatgatgatgtgttcgatgtctgaagga

SEQ ID NO: 3228 - DNA, 61 bp, Triticum aestivum
tagccgtaggtcgtagcacatagccgtttaygtaatgcatagttgtccgaaggaatgtttc

SEQ ID NO: 3229 - DNA, 71 bp, Triticum aestivum
taacctggggcttcttttttctccctataatatggrctgcccttttaagaaggaactgcagcgagggtgca

SEQ ID NO: 3230 - DNA, 71 bp, Triticum aestivum
gactacgcgttcctcccggtggtggcgctctaccckttgtgttgcctttctccaagcagttgtgcccttcg

SEQ ID NO: 3231 - DNA, 71 bp, Triticum aestivum
atatctttacaagtcatcgacttacatgcttctttktattatatgcacctatgcagtacttgttaatgggt

SEQ ID NO: 3232 - DNA, 71 bp, Triticum aestivum
gatgatataaccgtagccaaggaagcccagattttsttctgtgtatctataggagcttaattaggaggagg

SEQ ID NO: 3233 - DNA, 71 bp, Triticum aestivum
agtatataaaaaaacaagttgtcacccagatgaatycgaaactatgtcaatgtcgacggtgagtgtggacc

SEQ ID NO: 3234 - DNA, 71 bp, Triticum aestivum
ggacatcggcacatgctttattactgatctgatttkttgactgtttattttaggtttgcctacaccactga

SEQ ID NO: 3235 - DNA, 201 bp, Triticum aestivum
atggttgaatatgtgactgcatttggactcactccttgtttctgcatttcattgaagataagcatggccttatcaagcttcccagatttagcatgtgcatkaatcagtatgttgaagatacgacagtcaggtagaatgcagtatctttccattgaattgaagagattaatcatatcaactaagcatccttcggtggcatac

SEQ ID NO: 3236 - DNA, 71 bp, Triticum aestivum
ggaggcgcctactgtattaaattagctagtgtggcktgtttgaggataatggcacatataccttggcggtg

SEQ ID NO: 3237 - DNA, 71 bp, Triticum aestivum
tccaggcagggggcatcctcgacaatgatttcatckaagctgcatccccattccatcacgacgcggaggct

SEQ ID NO: 3238 - DNA, 71 bp, Triticum aestivum
tgtaagctaactatacatgaagagtgcaggcacackaaaacgttcatcctgaagtacaagagttattttgg

SEQ ID NO: 3239 - DNA, 59 bp, Triticum aestivum
ggagaaaggcgagattttagcacctaacgccgcaamccagatcaaatcgctgtcccttt

SEQ ID NO: 3240 - DNA, 71 bp, Triticum aestivum
aaccttggaagctatcattgcgcacttgaagagcartagtgtggacattcctgtttatgcttggagcttag

SEQ ID NO: 3241 - DNA, 71 bp, Triticum aestivum
cgcaggcagcgggcatgtatcctcgtctgacggatrcccagattattaaactgtcaccctgcacgcctgca

SEQ ID NO: 3242 - DNA, 298 bp, Triticum aestivum
gaggctaatcccgacgtgccacattgagcacgtgtgttcttgctgtggcctggtcgaaagacatgacgcatgcacgtgccccacgcctcacacggcttgggttctcgcctgtccggtgctcgacggaccagtacatatacgcgagcgctcctrgccacctcagttcatcacacttcactgcagtacaaggcctcggctctcggcagactcctcattgctgcttctgctagtgaaaagagagattcttcagcgctgctcctgaaagagataagaaatacgatggcaacaatggtcagag

SEQ ID NO: 3243 - DNA, 150 bp, Triticum aestivum
acttactgcgcgcagacgttgcagctcttcctgcagaagccaggagcttccttggtgcccaccatatagttggggttcttggcacactccccarcggcagcccactgcgagcagaggacattctcgtcctcgcagccgtcaccggagcct

SEQ ID NO: 3244 - DNA, 200 bp, Triticum aestivum
aagcaagctacgcgttgctcaaaaaaaaaaaaagcaagcaagctacgctgatcaaaggctgaatagtccagagttacaggacatggctactctgcagcrcccagcaagcttactacttaggttggtggagaagcagcacccactcgagactcgacaagcaaccttggacgttctactcgccagtgcattgctgctttacc

SEQ ID NO: 3245 - DNA, 71 bp, Triticum aestivum
accagagaaagagaggggaactttgggtatacaccrcattaccctagtgaaagaagaagggggtattatgt

SEQ ID NO: 3246 - DNA, 71 bp, Triticum aestivum
gaagggtccactgagaattaaggatgcattctttcratttggtatatttgttgtaaggaatgaagaatcgg

SEQ ID NO: 3247 - DNA, 200 bp, Triticum aestivum
tttcgtggcgggggatctcgtgccggtcgaggaggtccacctccagcgaattctgcagcaaccaacacaaacaggcccaaatgtccgaattcagagcasagcccgaccgaccgaccgcgaaatcgcgcggcatggcgttggcgtttggcgttggcgagaaggaaaaaggcactctatgcagaccttagcttggttatggc

SEQ ID NO: 3248 - DNA, 71 bp, Triticum aestivum
ttgccaaattcacaccatcattgatctggggtatcstatgcctatgtgatgcctctcacctctttcttccc

SEQ ID NO: 3249 - DNA, 71 bp, Triticum aestivum
ccgtgaaacctgtaaaaagatgtctgtgtgtctagsaaagccctaattttaatcaccccgtacgcccccct

SEQ ID NO: 3250 - DNA, 71 bp, Triticum aestivum
gcagcttcttgtttatatattctcttatcagaagtygggtagaacagctaacgatgtgctgctcatttcct

SEQ ID NO: 3251 - DNA, 71 bp, Triticum aestivum
tgatcttactgataaaatccggttcaaatatataayggtgagaaaaaattaaccagagcgaggcgagacat

SEQ ID NO: 3252 - DNA, 71 bp, Triticum aestivum
gttcatgtacaatgatgtttaacattggaacggtcygggatctgtttgatctatgcccccttcaacgtctt

SEQ ID NO: 3253 - DNA, 46 bp, Triticum aestivum
gaaggtgaccaagttcatgctgtaaaaagatgtctgtgtgtctagc

SEQ ID NO: 3254 - DNA, 46 bp, Triticum aestivum
gaaggtgaccaagttcatgctggtgaacaaaacaggcctacaatca

SEQ ID NO: 3255 - DNA, 47 bp, Triticum aestivum
gaaggtgaccaagttcatgctaatgatgtttaacattggaacggtcc

SEQ ID NO: 3256 - DNA, 39 bp, Triticum aestivum
gaaggtgaccaagttcatgctgtggtggcgctctacccg

SEQ ID NO: 3257 - DNA, 47 bp, Triticum aestivum
gaaggtgaccaagttcatgctaagtcatcgacttacatgcttctttg

SEQ ID NO: 3258 - DNA, 43 bp, Triticum aestivum
gaaggtgaccaagttcatgctagccaaggaagcccagattttc

SEQ ID NO: 3259 - DNA, 44 bp, Triticum aestivum
gaaggtgaccaagttcatgctaggggaactttgggtatacacca

SEQ ID NO: 3260 - DNA, 46 bp, Triticum aestivum
gaaggtgaccaagttcatgctgttaatgctgtagccattcttgcaa

SEQ ID NO: 3261 - DNA, 47 bp, Triticum aestivum
gaaggtgaccaagttcatgcttcagctgcataaaaamcagaatacca

SEQ ID NO: 3262 - DNA, 49 bp, Triticum aestivum
gaaggtgaccaagttcatgctgcacgtagtaagtattgatttttctgtg

SEQ ID NO: 3263 - DNA, 54 bp, Triticum aestivum
gaaggtgaccaagttcatgctcaaattacttttgttcttttatttttttcgaat

SEQ ID NO: 3264 - DNA, 48 bp, Triticum aestivum
gaaggtgaccaagttcatgctaattgttcacaacatggacatgagaac

SEQ ID NO: 3265 - DNA, 51 bp, Triticum aestivum
gaaggtgaccaagttcatgcttactgataaaatccggttcaaatatataac

SEQ ID NO: 3266 - DNA, 49 bp, Triticum aestivum
gaaggtgaccaagttcatgctggcttcttttttctccctataatatgga

SEQ ID NO: 3267 - DNA, 43 bp, Triticum aestivum
gaaggtgaccaagttcatgctgagaggcatcacataggcatag

SEQ ID NO: 3268 - DNA, 54 bp, Triticum aestivum
gaaggtgaccaagttcatgctattcttcattccttacaacaaatataccaaatt

SEQ ID NO: 3269 - DNA, 48 bp, Triticum aestivum
gaaggtgaccaagttcatgctagtagaataccacccaataaatcactg

SEQ ID NO: 3270 - DNA, 41 bp, Triticum aestivum
gaaggtgaccaagttcatgctctagcgcatgaggtctatcg

SEQ ID NO: 3271 - DNA, 43 bp, Triticum aestivum
gaaggtgaccaagttcatgctacatgaagagtgcaggcacacg

SEQ ID NO: 3272 - DNA, 51 bp, Triticum aestivum
gaaggtgaccaagttcatgctattgtttccatgttaagcttatattgtgca

SEQ ID NO: 3273 - DNA, 53 bp, Triticum aestivum
gaaggtgaccaagttcatgctaaaaacatctattccaagcaagtattagtaat

SEQ ID NO: 3274 - DNA, 51 bp, Triticum aestivum
gaaggtgaccaagttcatgcttcttgtttatatattctcttatcagaagtc

SEQ ID NO: 3275 - DNA, 46 bp, Triticum aestivum
gaaggtgaccaagttcatgctgaatctgattaagacgctggagaac

SEQ ID NO: 3276 - DNA, 50 bp, Triticum aestivum
gaaggtgaccaagttcatgctgattcaaagaggtgacaaatatgtgtact

SEQ ID NO: 3277 - DNA, 44 bp, Triticum aestivum
gaaggtgaccaagttcatgctggtcgtagcacatagccgtttac

SEQ ID NO: 3278 - DNA, 45 bp, Triticum aestivum
gaaggtgaccaagttcatgctacggaatcgagtcaaccaattcct

SEQ ID NO: 3279 - DNA, 49 bp, Triticum aestivum
gaaggtgaccaagttcatgctaacaacaattaygaggatcaaatggtca

SEQ ID NO: 3280 - DNA, 43 bp, Triticum aestivum
gaaggtgaccaagttcatgctatctagccacgcaaatgcccgt

SEQ ID NO: 3281 - DNA, 46 bp, Triticum aestivum
gaaggtgaccaagttcatgctaaagagcatgtcagacacaatgcag

SEQ ID NO: 3282 - DNA, 41 bp, Triticum aestivum
gaaggtgaccaagttcatgctggttcctgagagagcaacca

SEQ ID NO: 3283 - DNA, 44 bp, Triticum aestivum
gaaggtgaccaagttcatgctgacatctgatgagccagcataca

SEQ ID NO: 3284 - DNA, 48 bp, Triticum aestivum
gaaggtgaccaagttcatgctatctactcatctattgcagatgctctt

SEQ ID NO: 3285 - DNA, 51 bp, Triticum aestivum
gaaggtgaccaagttcatgctaaatgcctagtctatacctgataaactaaa

SEQ ID NO: 3286 - DNA, 42 bp, Triticum aestivum
gaaggtgaccaagttcatgctacctcctccgtatctgatggc

SEQ ID NO: 3287 - DNA, 53 bp, Triticum aestivum
gaaggtgaccaagttcatgcttaatttggttaaccaaatcctttttgattttt

SEQ ID NO: 3288 - DNA, 43 bp, Triticum aestivum
gaaggtgaccaagttcatgcttcccagatttagcatgtgcatt

SEQ ID NO: 3289 - DNA, 47 bp, Triticum aestivum
gaaggtgaccaagttcatgctactgtattaaattagctagtgtggcg

SEQ ID NO: 3290 - DNA, 48 bp, Triticum aestivum
gaaggtgaccaagttcatgctaaaaacaagttgtcacccagatgaatc

SEQ ID NO: 3291 - DNA, 45 bp, Triticum aestivum
gaaggtgaccaagttcatgctgcatcctcgacaatgatttcatcg

SEQ ID NO: 3292 - DNA, 46 bp, Triticum aestivum
gaaggtgaccaagttcatgctagattttagcacctaacgccgcaaa

SEQ ID NO: 3293 - DNA, 44 bp, Triticum aestivum
gaaggtgaccaagttcatgctgtcgmacccaatgaataatgttt

SEQ ID NO: 3294 - DNA, 45 bp, Triticum aestivum
gaaggtgaccaagttcatgctgttccttgtgacatgtactcataa

SEQ ID NO: 3295 - DNA, 45 bp, Triticum aestivum
gaaggtgaccaagttcatgctactgggtgcaaagccaagatgatt

SEQ ID NO: 3296 - DNA, 44 bp, Triticum aestivum
gaaggtgaccaagttcatgctggcgaaacttcgccgcgataaat

SEQ ID NO: 3297 - DNA, 48 bp, Triticum aestivum
gaaggtgaccaagttcatgctcaagttgctcttaattatctgtgcgta

SEQ ID NO: 3298 - DNA, 40 bp, Triticum aestivum
gaaggtgaccaagttcatgctcgtcccccatggcacctgt

SEQ ID NO: 3299 - DNA, 53 bp, Triticum aestivum
gaaggtgaccaagttcatgctatagcaagtagagttaacttatcaagttatta

SEQ ID NO: 3300 - DNA, 44 bp, Triticum aestivum
gaaggtgaccaagttcatgctggattttctcaccggcatctcca

SEQ ID NO: 3301 - DNA, 47 bp, Triticum aestivum
gaaggtgaccaagttcatgcttcccatgttctttttttgctcaaaac

SEQ ID NO: 3302 - DNA, 54 bp, Triticum aestivum
gaaggtgaccaagttcatgctatattgtttgtattaaaaagttgtgtgttttga

SEQ ID NO: 3303 - DNA, 45 bp, Triticum aestivum
gaaggtgaccaagttcatgctgccttttcttcttccagcatctac

SEQ ID NO: 3304 - DNA, 46 bp, Triticum aestivum
gaaggtgaccaagttcatgctagaatcgttcttcgagaagcactca

SEQ ID NO: 3305 - DNA, 42 bp, Triticum aestivum
gaaggtgaccaagttcatgctcctggagatggatccggtcag

SEQ ID NO: 3306 - DNA, 39 bp, Triticum aestivum
gaaggtgaccaagttcatgctcctgagctgggctgcacc

SEQ ID NO: 3307 - DNA, 44 bp, Triticum aestivum
gaaggtgaccaagttcatgctaaagggctatcctggtgaacaac

SEQ ID NO: 3308 - DNA, 45 bp, Triticum aestivum
gaaggtgaccaagttcatgctgttgccctgcgcaaaatcaaactt

SEQ ID NO: 3309 - DNA, 46 bp, Triticum aestivum
gaaggtgaccaagttcatgctgtactatggctatgtctctgaatgc

SEQ ID NO: 3310 - DNA, 44 bp, Triticum aestivum
gaaggtgaccaagttcatgctcattcgacgcgtcttccgcaata

SEQ ID NO: 3311 - DNA, 47 bp, Triticum aestivum
gaaggtgaccaagttcatgctgatgacatggaggattatatcgacga

SEQ ID NO: 3312 - DNA, 49 bp, Triticum aestivum
gaaggtgaccaagttcatgctgcacatgctttattactgatctgatttg

SEQ ID NO: 3313 - DNA, 44 bp, Triticum aestivum
gaaggtgaccaagttcatgctccaaatgtccgaattcagagcag

SEQ ID NO: 3314 - DNA, 42 bp, Triticum aestivum
gaaggtgaccaagttcatgctacatatacgcgagcgctcctg

SEQ ID NO: 3315 - DNA, 42 bp, Triticum aestivum
gaaggtgaccaagttcatgctggttcttggcacactccccag

SEQ ID NO: 3316 - DNA, 46 bp, Triticum aestivum
gaaggtgaccaagttcatgctaacctaagtagtaagcttgctgggt

SEQ ID NO: 3317 - DNA, 46 bp, Triticum aestivum
gaaggtcggagtcaacggattgtaaaaagatgtctgtgtgtctagg

SEQ ID NO: 3318 - DNA, 45 bp, Triticum aestivum
gaaggtcggagtcaacggattgtgaacaaaacaggcctacaatcc

SEQ ID NO: 3319 - DNA, 48 bp, Triticum aestivum
gaaggtcggagtcaacggattcaatgatgtttaacattggaacggtct

SEQ ID NO: 3320 - DNA, 40 bp, Triticum aestivum
gaaggtcggagtcaacggattggtggtggcgctctaccct

SEQ ID NO: 3321 - DNA, 48 bp, Triticum aestivum
gaaggtcggagtcaacggattcaagtcatcgacttacatgcttctttt

SEQ ID NO: 3322 - DNA, 43 bp, Triticum aestivum
gaaggtcggagtcaacggattagccaaggaagcccagattttg

SEQ ID NO: 3323 - DNA, 43 bp, Triticum aestivum
gaaggtcggagtcaacggattggggaactttgggtatacaccg

SEQ ID NO: 3324 - DNA, 46 bp, Triticum aestivum
gaaggtcggagtcaacggattgttaatgctgtagccattcttgcag

SEQ ID NO: 3325 - DNA, 46 bp, Triticum aestivum
gaaggtcggagtcaacggattcagctgcataaaaamcagaataccg

SEQ ID NO: 3326 - DNA, 49 bp, Triticum aestivum
gaaggtcggagtcaacggattgcacgtagtaagtattgatttttctgtt

SEQ ID NO: 3327 - DNA, 54 bp, Triticum aestivum
gaaggtcggagtcaacggattcaaattacttttgttcttttatttttttcgaac

SEQ ID NO: 3328 - DNA, 51 bp, Triticum aestivum
gaaggtcggagtcaacggattataaattgttcacaacatggacatgagaat

SEQ ID NO: 3329 - DNA, 53 bp, Triticum aestivum
gaaggtcggagtcaacggattcttactgataaaatccggttcaaatatataat

SEQ ID NO: 3330 - DNA, 48 bp, Triticum aestivum
gaaggtcggagtcaacggattgcttcttttttctccctataatatggg

SEQ ID NO: 3331 - DNA, 43 bp, Triticum aestivum
gaaggtcggagtcaacggattgagaggcatcacataggcatac

SEQ ID NO: 3332 - DNA, 51 bp, Triticum aestivum
gaaggtcggagtcaacggattcttcattccttacaacaaatataccaaatc

SEQ ID NO: 3333 - DNA, 48 bp, Triticum aestivum
gaaggtcggagtcaacggattagtagaataccacccaataaatcactc

SEQ ID NO: 3334 - DNA, 45 bp, Triticum aestivum
gaaggtcggagtcaacggattaactctagcgcatgaggtctatca

SEQ ID NO: 3335 - DNA, 45 bp, Triticum aestivum
gaaggtcggagtcaacggattatacatgaagagtgcaggcacact

SEQ ID NO: 3336 - DNA, 48 bp, Triticum aestivum
gaaggtcggagtcaacggattgtttccatgttaagcttatattgtgcg

SEQ ID NO: 3337 - DNA, 51 bp, Triticum aestivum
gaaggtcggagtcaacggattaaacatctattccaagcaagtattagtaac

SEQ ID NO: 3338 - DNA, 53 bp, Triticum aestivum
gaaggtcggagtcaacggattcttcttgtttatatattctcttatcagaagtt

SEQ ID NO: 3339 - DNA, 47 bp, Triticum aestivum
gaaggtcggagtcaacggattggaatctgattaagacgctggagaat

SEQ ID NO: 3340 - DNA, 46 bp, Triticum aestivum
gaaggtcggagtcaacggattcaaagaggtgacaaatatgtgtacc

SEQ ID NO: 3341 - DNA, 45 bp, Triticum aestivum
gaaggtcggagtcaacggattaggtcgtagcacatagccgtttat

SEQ ID NO: 3342 - DNA, 44 bp, Triticum aestivum
gaaggtcggagtcaacggattcggaatcgagtcaaccaattccc

SEQ ID NO: 3343 - DNA, 49 bp, Triticum aestivum
gaaggtcggagtcaacggattaacaacaattaygaggatcaaatggtct

SEQ ID NO: 3344 - DNA, 41 bp, Triticum aestivum
gaaggtcggagtcaacggattctagccacgcaaatgcccgc

SEQ ID NO: 3345 - DNA, 47 bp, Triticum aestivum
gaaggtcggagtcaacggattgaaagagcatgtcagacacaatgcaa

SEQ ID NO: 3346 - DNA, 41 bp, Triticum aestivum
gaaggtcggagtcaacggattggttcctgagagagcaaccg

SEQ ID NO: 3347 - DNA, 44 bp, Triticum aestivum
gaaggtcggagtcaacggattgacatctgatgagccagcatacc

SEQ ID NO: 3348 - DNA, 46 bp, Triticum aestivum
gaaggtcggagtcaacggattctactcatctattgcagatgctctg

SEQ ID NO: 3349 - DNA, 51 bp, Triticum aestivum
gaaggtcggagtcaacggattaaatgcctagtctatacctgataaactaat

SEQ ID NO: 3350 - DNA, 43 bp, Triticum aestivum
gaaggtcggagtcaacggattcacctcctccgtatctgatggt

SEQ ID NO: 3351 - DNA, 52 bp, Triticum aestivum
gaaggtcggagtcaacggattaatttggttaaccaaatcctttttgattttg

SEQ ID NO: 3352 - DNA, 45 bp, Triticum aestivum
gaaggtcggagtcaacggattcttcccagatttagcatgtgcatg

SEQ ID NO: 3353 - DNA, 49 bp, Triticum aestivum
gaaggtcggagtcaacggattctactgtattaaattagctagtgtggct

SEQ ID NO: 3354 - DNA, 50 bp, Triticum aestivum
gaaggtcggagtcaacggattaaaaaaacaagttgtcacccagatgaatt

SEQ ID NO: 3355 - DNA, 46 bp, Triticum aestivum
gaaggtcggagtcaacggattggcatcctcgacaatgatttcatct

SEQ ID NO: 3356 - DNA, 41 bp, Triticum aestivum
gaaggtcggagtcaacggattttagcacctaacgccgcaac

SEQ ID NO: 3357 - DNA, 46 bp, Triticum aestivum
gaaggtcggagtcaacggattctgtcgmacccaatgaataatgttc

SEQ ID NO: 3358 - DNA, 45 bp, Triticum aestivum
gaaggtcggagtcaacggattgttccttgtgacatgtactcatac

SEQ ID NO: 3359 - DNA, 45 bp, Triticum aestivum
gaaggtcggagtcaacggattactgggtgcaaagccaagatgata

SEQ ID NO: 3360 - DNA, 43 bp, Triticum aestivum
gaaggtcggagtcaacggattgcgaaacttcgccgcgataaac

SEQ ID NO: 3361 - DNA, 47 bp, Triticum aestivum
gaaggtcggagtcaacggattaagttgctcttaattatctgtgcgtg

SEQ ID NO: 3362 - DNA, 39 bp, Triticum aestivum
gaaggtcggagtcaacggattgtcccccatggcacctgc

SEQ ID NO: 3363 - DNA, 51 bp, Triticum aestivum
gaaggtcggagtcaacggattagcaagtagagttaacttatcaagttattg

SEQ ID NO: 3364 - DNA, 39 bp, Triticum aestivum
gaaggtcggagtcaacggattttctcaccggcatctccg

SEQ ID NO: 3365 - DNA, 49 bp, Triticum aestivum
gaaggtcggagtcaacggattcttcccatgttctttttttgctcaaaat

SEQ ID NO: 3366 - DNA, 54 bp, Triticum aestivum
gaaggtcggagtcaacggattatattgtttgtattaaaaagttgtgtgttttgc

SEQ ID NO: 3367 - DNA, 46 bp, Triticum aestivum
gaaggtcggagtcaacggattcgccttttcttcttccagcatctat

SEQ ID NO: 3368 - DNA, 44 bp, Triticum aestivum
gaaggtcggagtcaacggattaatcgttcttcgagaagcactcc

SEQ ID NO: 3369 - DNA, 42 bp, Triticum aestivum
gaaggtcggagtcaacggattcctggagatggatccggtcaa

SEQ ID NO: 3370 - DNA, 40 bp, Triticum aestivum
gaaggtcggagtcaacggattgcctgagctgggctgcact

SEQ ID NO: 3371 - DNA, 46 bp, Triticum aestivum
gaaggtcggagtcaacggattacaaagggctatcctggtgaacaat

SEQ ID NO: 3372 - DNA, 42 bp, Triticum aestivum
gaaggtcggagtcaacggattgccctgcgcaaaatcaaactc

SEQ ID NO: 3373 - DNA, 48 bp, Triticum aestivum
gaaggtcggagtcaacggattaagtactatggctatgtctctgaatgt

SEQ ID NO: 3374 - DNA, 40 bp, Triticum aestivum
gaaggtcggagtcaacggattcgacgcgtcttccgcaatg

SEQ ID NO: 3375 - DNA, 46 bp, Triticum aestivum
gaaggtcggagtcaacggattatgacatggaggattatatcgacgg

SEQ ID NO: 3376 - DNA, 50 bp, Triticum aestivum
gaaggtcggagtcaacggattggcacatgctttattactgatctgatttt

SEQ ID NO: 3377 - DNA, 44 bp, Triticum aestivum
gaaggtcggagtcaacggattccaaatgtccgaattcagagcac

SEQ ID NO: 3378 - DNA, 44 bp, Triticum aestivum
gaaggtcggagtcaacggattgtacatatacgcgagcgctccta

SEQ ID NO: 3379 - DNA, 42 bp, Triticum aestivum
gaaggtcggagtcaacggattggttcttggcacactccccaa

SEQ ID NO: 3380 - DNA, 44 bp, Triticum aestivum
gaaggtcggagtcaacggattcctaagtagtaagcttgctgggc

SEQ ID NO: 3381 - DNA, 19 bp, Triticum aestivum
aggggggcgtacggggtga

SEQ ID NO: 3382 - DNA, 29 bp, Triticum aestivum
gtgtgtgctaatgtggatatacgtaagtt

SEQ ID NO: 3383 - DNA, 25 bp, Triticum aestivum
gacgttgaagggggcatagatcaaa

SEQ ID NO: 3384 - DNA, 26 bp, Triticum aestivum
caactgcttggagaaaggcaacacaa

SEQ ID NO: 3385 - DNA, 29 bp, Triticum aestivum
ccattaacaagtactgcataggtgcatat

SEQ ID NO: 3386 - DNA, 28 bp, Triticum aestivum
cctcctcctaattaagctcctatagata

SEQ ID NO: 3387 - DNA, 25 bp, Triticum aestivum
cccccttcttctttcactagggtaa

SEQ ID NO: 3388 - DNA, 24 bp, Triticum aestivum
gtgcccataagacgactgggacaa

SEQ ID NO: 3389 - DNA, 25 bp, Triticum aestivum
ctgcgttaaggttcaggcaactgat

SEQ ID NO: 3390 - DNA, 29 bp, Triticum aestivum
gccaattttcaaatctaagtccacagaga

SEQ ID NO: 3391 - DNA, 29 bp, Triticum aestivum
atatgattcaccctagatccttcacctta

SEQ ID NO: 3392 - DNA, 21 bp, Triticum aestivum
gtttcctccaatgttcttccc

SEQ ID NO: 3393 - DNA, 25 bp, Triticum aestivum
tgtctcgcctcgctctggttaattt

SEQ ID NO: 3394 - DNA, 25 bp, Triticum aestivum
accctcgctgcagttccttcttaaa

SEQ ID NO: 3395 - DNA, 29 bp, Triticum aestivum
aaattcacaccatcattgatctggggtat

SEQ ID NO: 3396 - DNA, 29 bp, Triticum aestivum
gtccactgagaattaaggatgcattcttt

SEQ ID NO: 3397 - DNA, 29 bp, Triticum aestivum
aagtagtactcgtagagagttaacacaga

SEQ ID NO: 3398 - DNA, 25 bp, Triticum aestivum
gcttgacaatgataatgcccccgaa

SEQ ID NO: 3399 - DNA, 30 bp, Triticum aestivum
aataactcttgtacttcaggatgaacgttt

SEQ ID NO: 3400 - DNA, 29 bp, Triticum aestivum
gccctttggtaattccatttcaatctttt

SEQ ID NO: 3401 - DNA, 26 bp, Triticum aestivum
gatgaggaaggtcttcatgttgggtt

SEQ ID NO: 3402 - DNA, 25 bp, Triticum aestivum
gagcagcacatcgttagctgttcta

SEQ ID NO: 3403 - DNA, 26 bp, Triticum aestivum
cagatggcctagtcgtgacatatctt

SEQ ID NO: 3404 - DNA, 29 bp, Triticum aestivum
taaaagaacacaaatgtggccctagtgat

SEQ ID NO: 3405 - DNA, 29 bp, Triticum aestivum
gaaacattccttcggacaactatgcatta

SEQ ID NO: 3406 - DNA, 25 bp, Triticum aestivum
gcatcttcaagggagccactcaaaa

SEQ ID NO: 3407 - DNA, 30 bp, Triticum aestivum
atcattgccacgraaaaaatctcacaagat

SEQ ID NO: 3408 - DNA, 25 bp, Triticum aestivum
ccttgtccaccgagacatgtacaaa

SEQ ID NO: 3409 - DNA, 29 bp, Triticum aestivum
cctgctggaaatgggatttcttgtttatt

SEQ ID NO: 3410 - DNA, 23 bp, Triticum aestivum
gcttcctctcggtagcgatggat

SEQ ID NO: 3411 - DNA, 26 bp, Triticum aestivum
gggacgtggaatttggaaagacacat

SEQ ID NO: 3412 - DNA, 29 bp, Triticum aestivum
tataggagtgatagcaccacacaattcat

SEQ ID NO: 3413 - DNA, 29 bp, Triticum aestivum
tgtaccgaaactcaaccaaatgaccattt

SEQ ID NO: 3414 - DNA, 22 bp, Triticum aestivum
cagaaggcactgggaggggatt

SEQ ID NO: 3415 - DNA, 30 bp, Triticum aestivum
gcacaatgtttgacattcggttttctagtt

SEQ ID NO: 3416 - DNA, 29 bp, Triticum aestivum
ctgactgtcgtatcttcaacatactgatt

SEQ ID NO: 3417 - DNA, 28 bp, Triticum aestivum
ccaaggtatatgtgccattatcctcaaa

SEQ ID NO: 3418 - DNA, 26 bp, Triticum aestivum
cactcaccgtcgacattgacatagtt

SEQ ID NO: 3419 - DNA, 22 bp, Triticum aestivum
agcctccgcgtcgtgatggaat

SEQ ID NO: 3420 - DNA, 23 bp, Triticum aestivum
aaagggacagcgatttgatctgg

SEQ ID NO: 3421 - DNA, 21 bp, Triticum aestivum
gccatcctctcggagccagaa

SEQ ID NO: 3422 - DNA, 25 bp, Triticum aestivum
caaggatggggagtatatggctctt

SEQ ID NO: 3423 - DNA, 25 bp, Triticum aestivum
cctcccaacggccatcaatcaattt

SEQ ID NO: 3424 - DNA, 26 bp, Triticum aestivum
gatcatcggggaacctgatgatagtt

SEQ ID NO: 3425 - DNA, 28 bp, Triticum aestivum
ttggttggttacgtcaggttaagactta

SEQ ID NO: 3426 - DNA, 24 bp, Triticum aestivum
cttctctgtggccgaaaacctctt

SEQ ID NO: 3427 - DNA, 28 bp, Triticum aestivum
gctktagactctaagtaccacagaagaa

SEQ ID NO: 3428 - DNA, 29 bp, Triticum aestivum
cctaccatccttaaatactcttgctcaaa

SEQ ID NO: 3429 - DNA, 30 bp, Triticum aestivum
aagcaactagaaaaatatttggactagcat

SEQ ID NO: 3430 - DNA, 30 bp, Triticum aestivum
gttgatgcgaatttgaaaatgacataataa

SEQ ID NO: 3431 - DNA, 25 bp, Triticum aestivum
ttgactcgattccgtgtgaggctaa

SEQ ID NO: 3432 - DNA, 30 bp, Triticum aestivum
aatatgatacagacccaagacaaaccattt

SEQ ID NO: 3433 - DNA, 22 bp, Triticum aestivum
tcctcacaaatcacgggcccct

SEQ ID NO: 3434 - DNA, 24 bp, Triticum aestivum
gaccgtggtatatgccaccacgtt

SEQ ID NO: 3435 - DNA, 29 bp, Triticum aestivum
ggcttcattatcaaattctgacccatctt

SEQ ID NO: 3436 - DNA, 22 bp, Triticum aestivum
gggcgggacctgacttgatgat

SEQ ID NO: 3437 - DNA, 30 bp, Triticum aestivum
acgacaatatagacaaataaaaccaaacaa

SEQ ID NO: 3438 - DNA, 19 bp, Triticum aestivum
ccgcggccgaagcaggcaa

SEQ ID NO: 3439 - DNA, 22 bp, Triticum aestivum
atacatgtcggcgtcccagtcc

SEQ ID NO: 3440 - DNA, 30 bp, Triticum aestivum
ggtgtaggcaaacctaaaataaacagtcaa

SEQ ID NO: 3441 - DNA, 22 bp, Triticum aestivum
caacgccaaacgccaacgccat

SEQ ID NO: 3442 - DNA, 25 bp, Triticum aestivum
gccttgtactgcagtgaagtgtgat

SEQ ID NO: 3443 - DNA, 22 bp, Triticum aestivum
tgacggctgcgaggacgagaat

SEQ ID NO: 3444 - DNA, 25 bp, Triticum aestivum
agtccagagttacaggacatggcta

SEQ ID NO: 3445 - DNA, 71 bp, Triticum aestivum
aagtctgccatccagatcattacccaacggccaatggagccatgaggtttgcctcgttgcacgttttggct

SEQ ID NO: 3446 - DNA, 71 bp, Triticum aestivum
gcaacaaagctggtcatccaaacatttacatcgttaggcaggctttccgcccaaaccatgcggccgacctg

SEQ ID NO: 3447 - DNA, 71 bp, Triticum aestivum
tatgtaaaacctctttgtttctaaatagctgcggctcgctacctaaatttatgttgaacctagaggcaccc

SEQ ID NO: 3448 - DNA, 71 bp, Triticum aestivum
gttcggcagaatccaagtcgcaaatgtaaggtcagcaaatgaatgatgatcatgataatgaaaatcataag

SEQ ID NO: 3449 - DNA, 71 bp, Triticum aestivum
acgtatggagcttcctcttttcatcatgcaccattgtgatctccctcttattttgtctgaagccattcatg

SEQ ID NO: 3450 - DNA, 71 bp, Triticum aestivum
aggtcatgaaaatgcaagtggcgaatcttatctctgttataccatttggcaaaacaaaggcgagagttctg

SEQ ID NO: 3451 - DNA, 71 bp, Triticum aestivum
aagtctgccatccagatcattacccaacggccaattgagccatgaggtttgcctcgttgcacgttttggct

SEQ ID NO: 3452 - DNA, 71 bp, Triticum aestivum
gcaacaaagctggtcatccaaacatttacatcgttcggcaggctttccgcccaaaccatgcggccgacctg

SEQ ID NO: 3453 - DNA, 71 bp, Triticum aestivum
tatgtaaaacctctttgtttctaaatagctgcggcccgctacctaaatttatgttgaacctagaggcaccc

SEQ ID NO: 3454 - DNA, 71 bp, Triticum aestivum
gttcggcagaatccaagtcgcaaatgtaaggtcagaaaatgaatgatgatcatgataatgaaaatcataag

SEQ ID NO: 3455 - DNA, 71 bp, Triticum aestivum
acgtatggagcttcctcttttcatcatgcaccattatgatctccctcttattttgtctgaagccattcatg

SEQ ID NO: 3456 - DNA, 71 bp, Triticum aestivum
aggtcatgaaaatgcaagtggcgaatcttatctctattataccatttggcaaaacaaaggcgagagttctg

SEQ ID NO: 3457 - DNA, 3983 bp, Triticum aestivum
aaataaagccagggactggggaatgagaagataatgtttataaggggttttctgtaaaaagaaagagcaacctacgcggcccctctgtcgatttggcatgggtcaacgcaccacacgagcaggtcaacgagcgctcgtgagaaaaaggacctagggtaaatcacttactaaagaattaggacctaaaggtgcattttggacgaaataagactaaagtgacaccctgacgaattttttaggaccttgagtgcatttaactctttcaaaaaataaagatgctaaaaaaactaaatgcttaaaaatacatttttctatgggaatacttaaaaatactagtataatttgatggcttcctagtatatttctagggcttacaactaaatttatattcttggtctaaataaaattataatctgataaattatgtgatatgaatatagccatatgagaccataatttaattttacctgcaaaaagtaagtaatagtagtagtagtactacgtactccctccgtccggaaatacttgtcgaagaatttgatgaaaatggatgcatctagaacaagaatacatctagatacatcaatctccccgacaagtatttccgaacggagggagtactagataataagataactaccctaaaaaaaaaagataactgaaggttgccacctagcacattcacattggtacaacttggaaaagcacagccccgtcgtcctgctcccagttgagttcgcgacctacacagcggccatgccccgcttctcctccaccacgccaatgtcgccaccccgcctccgcctccgactctgcgcccgccactcctcctgcacctctcatccctcacgcatctgggatccccacgccgccttcgccgccgcggcacagcgggcgagctctggcacgctcactacggaggacgcacaccacctgtttgacgaattgctgcggcggggcaatcctgtccaggagcgtcccttgaataaatttctggctgccctcgcccgcgcgcccgcgtccgcatcctgctgcgatggccccgccctggcagtcgccctcttcggccgtttgtcccaagacgtcagacgacgggtggcgcagccaaatgtcttcacctatggcgtcctcatggactgctgctgccgcgcttgccgcacagatctggcgctcgccttctttggccgtctcctcaagacgggcctggaggcaaaccaagtcgtcttcaacaccctcctcaagggcctttgccacacaaagcgggcggatgaggctctggacgtgctgcttcacaggatgcctgagctgggctgcactcctgatgtggtggcgtataacaccgttatccatggcttctttaaggaaggccatgtaagcaaggcctgcaatctgttccatgaaatggcgcagcagggcgttaagcctaatgtggtgacatataactcagttatcgatgcgctgtgcaaggccagagccatggacaaggcagaggtggtccttcgtcagatgattgatgatggtgttggaccttaatgtgacgtatagtagcctcatccatggatattcctcttcaggccactggaaggaggcagttagggtattcaaagagatgacaagtcggagggttacagcagatgtgcatacttacaacatgtttatgacctttctttgcaaacatggaagaagcaaagaagctgcaggaatttttgataccatggctatcaagggcctgaaacctgacaacgtttcatatgctattctccttcatgggtatgccgccgaaggatgcttagttgatatgattaatctcttcaattcaatggaaagagattgtattctacctgactgtcgtatcttcaacatactgattaatgcatatgctaaatctgggaagcttgataaggctatgcttatcttcaatgaaatgcagaaacaaggagtgagtccaaatgcagtcacatattcaaccgtaatacatgcattttgcaagaagggtaggttggatgatgctgtgataaagtttaatcagatgattgatacaggagtacgaccggacgcatctgtttatcgtcccctaatccagggtttttgtacacatggcgatttggtgaaagcaaaggaatatgttactgaaatgatgaagaaaggtatgcctcctcctgatattatgttcttcagttcaatcatgcagaacctatgcacagaaggaagggtaacagaagcacgggatatccttgacttgatagtgcacattggtatgaggcctaatgttatcatatttaatttgctgatcggtggatactgcctagtccgcaagatggcagatgcattgaaagtatttgatgatatggtgtcatatggtttagaaccttgtaactttacgtatggtatacttattaatggctattgcaaaaatagaaggattgatgacgggcttattctgttcaaagagatgctgcacaagggacttaaacctacaacttttaattataacgtcatactggatggattatttctggctggacaaactgttgctgcaaaagagaagtttgatgagatggttgaatctggagtaagtgtgtgcattgatacatactctataattcttggtggactttgtagaaatagctgcagtagcgaagcgatcacccttttccggaaattaagcgcaatgaatgtgaaatttgatattacaattgtcaatatcattattggtgccttatacagggtcgagagaaaccaagaggctaaggatttgtttgctgctatgccagccaatggcttggttcctaatgctgttacctacaccgtaatgatgacaaatcttataaaagaaggttcagtggaagaagctgacaatcttttcttatccatggagaagagcggctgtactgccaactcttgcctgttaaatcatatcatcagaaggttactggaaaaaggagagatagtcaaggctggaaattatatgtctaaagttgatgcaaagagctactcacttgaagctaaaactgtttcgctgctgatctctctgttttcaaggaaagggaaatatagagaacacatcaaattgcttcctacaaagtatcagtttctggaagaagcagccacagttgaatagttggtacatgatatctgaaatttaatttgcatcgcttgccatgggtccgtctgcttgtacaagaaatgcattttctatttgtaaataggaagtcagtttagaacaagccatcaggatgacgcaaagagtacaattcagttgcaccaccaataaaaaggcagaactagggctgccaaaacaacactgaatcaaaactcaaacagaaggagcagcaaactttttttttttgaagctggacagtctgctagccaaacaactacaggagactgtcaggcggggcatgtagtggctggcgtctaagcgcctttgcttcttccaccatccatggcttagcctcacacggaatcgagtcaaccaattcccgtcggttttgggtggctcccttgaagatgcaattgttttcagcggccagatacgcatggtcagattaatcagcgagtgtgccccttctgtctggttcgagaaagaatttgaagagctgagcttgtccccgctggaaccagtttgaggttagttaatcataacagggtactagagaggtgttttattgactgttgatgtgtaatatgttatatgccatcctcttgatgattacggtgatctgtgaagaggcaggatgcaaaagtgtgaatcacatatgcttatgtaattgtgttattatttgtgcagcttctagaccttttgcctgtagatggctacatggatctagttgtagcaatctgtaactgttagtgttttgtatatgctggcattgatgattagggtgacttgtgaagcatgcagaagtctgaatcatacatgcttgtctacttatttttggaactctctctttgccatgtacatgttttatgaatgcagttgt

SEQ ID NO: 3458 - protein, 258 aa, Triticum aestivum; identical to SEQ ID NO: 157

SEQ ID NO: 3459 - protein, 535 aa, Triticum aestivum; identical to SEQ ID NO: 155

SEQ ID NO: 3460 - DNA, 247 bp, Triticum aestivum
ctccgtccgaaaatacttgtcgaagaatttgatgaaaatggatgcatctagaacaagaatacatctagatacatcaatctccccgacaagtatttccgaacggagggagtactagataataagataactatccaaaaaaaaaaagataactgaaggttgccacctagcacattcacattggtacaacttggaaaagcacagccccgtcgtcctgctcccagttgagttcgcgacctacacaccggcc

SEQ ID NO: 3461 - DNA, 409 bp, Triticum aestivum
ctccgtccggaaatacttgtcgaagaatttgatgaaaatggatgcatctagaacaagaatacatctagatacatcaatctccctgacaagtatttccgagcggagggagtactagataatactccctccgttcctaaataattgtctttctagctatctcaaataaactacaacatacggatgtatgtagacatgttttagagtgtagattcactcattttgttccgtatgtagtcatttgttgaaatctctagagagacaattatttaggaacggagggagtaagataactaccctaaaaaaaaagataactgaaggttgccacctagcacattcacattggtacaacttggaaaagcacagccccgtcgtcctgctcccagttgagttcgcgacctacacaccggcc

SEQ ID NO: 3462 - DNA, 201 bp, Triticum aestivum; identical to SEQ ID NO: 3235

SEQ ID NO: 3463 - DNA, 71 bp, Triticum aestivum; identical to SEQ ID NO: 3236

SEQ ID NO: 3464 - DNA, 71 bp, Triticum aestivum; identical to SEQ ID NO: 3237

SEQ ID NO: 3465 - DNA, 71 bp, Triticum aestivum; identical to SEQ ID NO: 3238

SEQ ID NO: 3466 - DNA, 59 bp, Triticum aestivum; identical to SEQ ID NO: 3239

SEQ ID NO: 3467 - DNA, 71 bp, Triticum aestivum; identical to SEQ ID NO: 3240

SEQ ID NO: 3468 - DNA, 71 bp, Triticum aestivum; identical to SEQ ID NO: 3241

SEQ ID NO: 3469 - DNA, 298 bp, Triticum aestivum; identical to SEQ ID NO: 3242

SEQ ID NO: 3470 - DNA, 150 bp, Triticum aestivum; identical to SEQ ID NO: 3243

SEQ ID NO: 3471 - DNA, 200 bp, Triticum aestivum; identical to SEQ ID NO: 3244

SEQ ID NO: 3472 - DNA, 71 bp, Triticum aestivum; identical to SEQ ID NO: 3245

SEQ ID NO: 3473 - DNA, 71 bp, Triticum aestivum; identical to SEQ ID NO: 3246

SEQ ID NO: 3474 - DNA, 200 bp, Triticum aestivum; identical to SEQ ID NO: 3247

SEQ ID NO: 3475 - DNA, 71 bp, Triticum aestivum; identical to SEQ ID NO: 3248

SEQ ID NO: 3476 - DNA, 71 bp, Triticum aestivum; identical to SEQ ID NO: 3249

SEQ ID NO: 3477 - DNA, 71 bp, Triticum aestivum; identical to SEQ ID NO: 3250

SEQ ID NO: 3478 - DNA, 71 bp, Triticum aestivum; identical to SEQ ID NO: 3251

SEQ ID NO: 3479 - DNA, 71 bp, Triticum aestivum; identical to SEQ ID NO: 3252

The invention claimed is:

1. A wheat plant restorer of fertility of *T. timopheevii* CMS cytoplasm comprising:
   a Rf1 restorer allele comprising a nucleic acid encoding a Rf1 protein restorer of fertility of *T. timopheevii* CMS cytoplasm, wherein the corresponding amino acid sequence has at least 95% identity to SEQ ID NO:361,
   a Rf3 restorer allele within the Rf3 locus, wherein the Rf3 locus comprises one or more of the following SNP allele(s):

| SNP# | Marker Name | Marker SEQ ID | Restorer Allele |
|---|---|---|---|
| SNP17 | cfn1252000 | 3203 | A |
| SNP18 | IWB14060* | 3204 | G |
| SNP19 | cfn1249269 | 3205 | G |
| SNP20 | 219K1_166464 | 3206 | T |
| SNP21 | 219K1_158251 | 3207 | G |
| SNP22 | 219K1_111446 | 3208 | A |
| SNP23 | 219K1_110042 | 3209 | T |
| SNP24 | 219K1_110005 | 3210 | C |
| SNP25 | 219K1_107461 | 3211 | A |
| SNP26 | 219K1_99688 | 3212 | T |
| SNP27 | 219K1_37 | 3213 | C |
| SNP28 | cfn1270524 | 3214 | T |
| SNP29 | 136H5_3M5_7601 | 3215 | T |
| SNP30 | cfn1288811 | 3216 | G |
| SNP31 | 136H5_3M5_89176 | 3217 | A |
| SNP32 | 136H5_3M5_89263 | 3218 | T |
| SNP33 | 136H5_3M5_138211 | 3219 | T |
| SNP34 | cfn0556874 | 3220 | C |
| SNP35 | 136H5_3M5_64154 | 3221 | C |
| SNP36 | 136H5_3M5_68807 | 3222 | G |
| SNP37 | 136H5_3M5_77916 | 3223 | A |
| SNP38 | cfn1246088 | 3224 | A |
| SNP39 | cfn1287194 | 3225 | G |
| SNP40 | cfn1258380 | 3226 | A |
| SNP41 | IWB72107* | 3227 | A |
| SNP42 | BS00090770 | 3228 | T |
| SNP43 | cfn1239345 | 3229 | A | and
   a Rf7 restorer allele within the Rf7 locus, wherein the Rf7 locus comprises one or more of the following SNP allele(s):

| SNP# | Marker Name | Marker SEQ ID | Restorer Allele |
|---|---|---|---|
| SNP44 | cfn0917304 | 3230 | T |
| SNP45 | cfn0919993 | 3231 | G |
| SNP46 | cfn0920459 | 3232 | C |
| SNP49 | cfn0915987 | 3445 | G |
| SNP50 | cfn0920253 | 3446 | A |
| SNP51 | cfn0448874 | 3447 | T |
| SNP52 | cfn0923814 | 3448 | C |
| SNP53 | cfn0924180 | 3449 | G |
| SNP54 | cfn0919484 | 3450 | G. |

2. The wheat plant according to claim 1, wherein said Rf3 restorer allele is located within the chromosomal fragment between SNP markers cfn1249269 and BS00090770.

3. The wheat plant according to claim 2, wherein the corresponding amino acid sequence of the Rf3 restorer allele has at least 95% identity to an amino acid selected from the group consisting of SEQ ID NO: 158, SEQ ID NO: 676 and SEQ ID NO: 684.

4. The wheat plant according to claim 1, wherein said Rf3 locus comprises SEQ ID NO:1712, SEQ ID NO:3147, SEQ ID NO:2230, SEQ ID NO:3148 or SEQ ID NO:2238.

5. A method for producing the wheat plant according to claim 1, said method comprising:
   a. providing a first wheat plant comprising one or two restorer allele selected among Rf1, Rf3 and Rf7 restorer alleles,
   b. crossing said first wheat plant with a second wheat plant comprising one or two restorer alleles selected among Rf1, Rf3 and Rf7 restorer alleles, wherein Rf1, Rf3 and Rf7 restorer alleles are represented at least once in the panel of restorer alleles provided by the first plant and the second plant,
   c. collecting the F1 hybrid seed, and
   d. obtaining homozygous plants from the F1 plants.

6. A method for producing a wheat hybrid plant, said method comprising:
   a. crossing a sterile female comprising the *T. timopheevii* cytoplasm with a fertile male wheat plant according to claim 1; and
   b. collecting the hybrid seed.

7. The method according to claim 6, further comprising: detecting the presence of at least three of Rf locus chosen amongst Rf1, Rf3, and Rf7 in the hybrid seeds.

8. A wheat hybrid plant as obtained by the method according to claim 7.

9. A method of identifying a wheat plant according to claim 1, said method comprising:
   identifying said wheat plant by detecting the presence of the restorer alleles Rf1, Rf3 and Rf7.

10. At least three nucleic acid probes or primers for the specific detection of the restorer alleles Rf1, Rf3 or Rf7 in a wheat plant, wherein the at least three nucleic acid probes or primers are chosen among:
   SEQ ID NOs: 3254, 3259, 3261-3265, 3269-3275, 3279, 3280, 3282, 3293, 3294, 3309, 3318, 3323, 3325-3329, 3333-3339, 3343, 3344, 3346, 3357, 3358, 3373, 3382, 3387, 3389-3393, 3397-3403, 3407, 3408, 3410, 3421, 3422, and 3437 for the specific detection of restorer SNP marker(s) in locus Rf1, SEQ ID NOs: 3253, 3255, 3260, 3266-3268, 3276-3278, 3281, 3283-3288, 3295-3308, 3310, 3311, 3313-3317, 3319, 3324, 3330-3332, 3340-3342, 3345, 3347-3352, 3359-3372, 3374, 3375, 3377-3381, 3383, 3388, 3394-3396, 3404-3406, 3409, 3411-3416, 3423-3436, 3438, 3439, and 3441-3444 for the specific detection of restorer SNP marker(s) in locus Rf3, and/or SEQ ID NOs: 3256-3258, 3320-3322, and 3384-3386 for the specific detection of restorer SNP marker(s) in locus Rf7.

11. The wheat plant according to claim 3, wherein the corresponding amino acid sequence of the Rf3 restorer allele has at least 98% identity to an amino acid selected from the group consisting of SEQ ID NO: 158, SEQ ID NO: 676 and SEQ ID NO: 684.

12. The wheat plant according to claim 3, wherein the corresponding amino acid sequence of the Rf3 restorer allele has 100% identity to an amino acid selected from the group consisting of SEQ ID NO: 158, SEQ ID NO: 676 and SEQ ID NO:684.

13. The method according to claim 5, further comprising:
detecting the presence of the Rf1, Rf3 and Rf7 restorer alleles in the hybrid seed and/or detecting the presence of the Rf1, Rf3 and Rf7 restorer alleles at each generation.

14. The method according to claim 6, further comprising:
detecting hybridity level of the hybrid seeds.

* * * * *